(12) United States Patent
Jin et al.

(10) Patent No.: US 8,710,209 B2
(45) Date of Patent: Apr. 29, 2014

(54) MODULATION OF HSP47 EXPRESSION

(75) Inventors: Xiaomei Jin, Oceanside, CA (US); Lei Yu, Oceanside, CA (US); Hirokazu Takahashi, Sapporo (JP); Yasunobu Tanaka, Sapporo (JP); Yoshiro Niitsu, Sapporo (JP); Elena Feinstein, Rehovot (IL); Sharon Avkin-Nachum, Nes Ziona (IL); Hagar Kalinski, Rishon Le-Zion (IL); Igor Mett, Rehovot (IL); Shai Erlich, Belmont, CA (US); Elizabeth C. Squiers, Half Moon Bay, CA (US); Ning Chen, Pittsburgh, PA (US)

(73) Assignee: Nitto Denko Corporation, Osaka (JP)

( * ) Notice: Subject to any disclaimer, the term of this patent is extended or adjusted under 35 U.S.C. 154(b) by 71 days.

(21) Appl. No.: 12/963,600

(22) Filed: Dec. 8, 2010

(65) Prior Publication Data

US 2011/0178157 A1 Jul. 21, 2011

Related U.S. Application Data

(60) Provisional application No. 61/372,072, filed on Aug. 9, 2010, provisional application No. 61/307,412, filed on Feb. 23, 2010, provisional application No. 61/285,149, filed on Dec. 9, 2009.

(51) Int. Cl.
C07H 21/04 (2006.01)

(52) U.S. Cl.
USPC ......... 536/24.5; 536/24.31; 536/24.1; 514/44

(58) Field of Classification Search
None
See application file for complete search history.

(56) References Cited

U.S. PATENT DOCUMENTS

| | | | |
|---|---|---|---|
| 4,486,194 A | 12/1984 | Ferrara | |
| 4,487,603 A | 12/1984 | Harris | |
| 4,501,729 A | 2/1985 | Boucher et al. | |
| 4,925,678 A | 5/1990 | Ranney | |
| 4,959,217 A | 9/1990 | Sanders et al. | |
| 5,138,045 A | 8/1992 | Cook et al. | |
| 5,167,616 A | 12/1992 | Haak et al. | |
| 5,169,383 A | 12/1992 | Gyory et al. | |
| 5,214,136 A | 5/1993 | Lin et al. | |
| 5,225,182 A | 7/1993 | Sharma | |
| 5,624,803 A | 4/1997 | Noonberg et al. | |
| 5,898,031 A | 4/1999 | Crooke | |
| 6,107,094 A | 8/2000 | Crooke | |
| 6,153,737 A | 11/2000 | Manoharan et al. | |
| 6,180,613 B1 | 1/2001 | Kaplitt et al. | |
| 6,235,310 B1 | 5/2001 | Wang et al. | |
| 6,235,886 B1 | 5/2001 | Manoharan et al. | |
| 6,335,434 B1 | 1/2002 | Guzaev et al. | |
| 6,395,713 B1 | 5/2002 | Beigelman et al. | |
| 6,447,796 B1 | 9/2002 | Vook et al. | |
| 6,528,631 B1 | 3/2003 | Cook et al. | |
| 6,565,885 B1 | 5/2003 | Tarara et al. | |
| 6,582,728 B1 | 6/2003 | Platz et al. | |
| 6,586,524 B2 | 7/2003 | Sagara | |
| 6,592,904 B2 | 7/2003 | Platz et al. | |
| 6,602,858 B2 | 8/2003 | Beigelman | |
| 7,691,997 B2 * | 4/2010 | Khvorova et al. | 536/24.5 |
| 2001/0007666 A1 | 7/2001 | Hoffman et al. | |
| 2002/0130430 A1 | 9/2002 | Castor | |
| 2002/0147332 A1 | 10/2002 | Kaneko et al. | |
| 2003/0077829 A1 | 4/2003 | MacLachlan | |
| 2004/0037780 A1 | 2/2004 | Parsons et al. | |
| 2004/0203145 A1 | 10/2004 | Zamore et al. | |
| 2004/0224405 A1 | 11/2004 | Leake et al. | |
| 2005/0244858 A1 | 11/2005 | Rossi et al. | |
| 2005/0255487 A1 | 11/2005 | Khvorova et al. | |
| 2006/0058266 A1 * | 3/2006 | Manoharan et al. | 514/81 |
| 2006/0134663 A1 | 6/2006 | Harkin et al. | |
| 2006/0216722 A1 | 9/2006 | Betsholtz et al. | |
| 2006/0258751 A1 | 11/2006 | Zhao et al. | |
| 2007/0031844 A1 | 2/2007 | Khvorova et al. | |
| 2007/0042982 A1 | 2/2007 | Bentwich | |
| 2007/0155658 A1 | 7/2007 | Quay et al. | |
| 2007/0173476 A1 | 7/2007 | Leake et al. | |
| 2007/0184439 A1 | 8/2007 | Guilford et al. | |
| 2007/0265220 A1 | 11/2007 | Rossi et al. | |
| 2008/0132723 A1 | 6/2008 | Johnston et al. | |
| 2008/0193512 A1 | 8/2008 | Niitsu et al. | |
| 2009/0105179 A1 | 4/2009 | Yu et al. | |
| 2009/0186410 A1 * | 7/2009 | Aronin et al. | 435/375 |
| 2009/0192104 A1 | 7/2009 | McSwiggen et al. | |
| 2010/0028416 A1 | 2/2010 | Yu et al. | |
| 2011/0104255 A1 | 5/2011 | Niitsu et al. | |

(Continued)

FOREIGN PATENT DOCUMENTS

| WO | WO-89/02439 | 3/1989 |
|---|---|---|
| WO | WO-93/23569 | 11/1993 |

(Continued)

OTHER PUBLICATIONS

Ui-Tei et al. (Nucleic Acids Research 2004, vol. 32:936-948).*

(Continued)

*Primary Examiner* — Kimberly Chong

(74) *Attorney, Agent, or Firm* — Sughrue Mion, PLLC

(57) ABSTRACT

Provided herein are compositions, methods and kits for modulating expression of target genes, particularly heat shock protein 47 (hsp47). The compositions, methods and kits may include nucleic acid molecules (for example, short interfering nucleic acid (siNA), short interfering RNA (siRNA), double-stranded RNA (dsRNA), micro-RNA (miRNA) or short hairpin RNA (shRNA)) that modulate a gene encoding hsp47, for example, the gene encoding human hsp47. The composition and methods disclosed herein may also be used in treating conditions and disorders associated with hsp47 such as liver fibrosis, pulmonary fibrosis, peritoneal fibrosis and kidney fibrosis.

37 Claims, 20 Drawing Sheets

(56) References Cited

U.S. PATENT DOCUMENTS

| | | |
|---|---|---|
| 2011/0112168 A1 | 5/2011 | Feinstein et al. |
| 2011/0229558 A1 | 9/2011 | Niitsu et al. |
| 2011/0257249 A1 | 10/2011 | Niitsu et al. |

FOREIGN PATENT DOCUMENTS

| | | |
|---|---|---|
| WO | WO-94/02595 | 2/1994 |
| WO | WO-95/06731 | 3/1995 |
| WO | WO-95/11910 | 5/1995 |
| WO | WO-96/18736 | 6/1996 |
| WO | WO-98/39352 | 9/1998 |
| WO | WO-99/07409 | 2/1999 |
| WO | WO-99/14226 | 3/1999 |
| WO | WO 99/31262 | 6/1999 |
| WO | WO-99/32619 | 7/1999 |
| WO | WO-99/61631 | 12/1999 |
| WO | WO-00/01846 | 1/2000 |
| WO | WO-00/03683 | 1/2000 |
| WO | WO-00/44895 | 8/2000 |
| WO | WO-00/44914 | 8/2000 |
| WO | WO-00/47599 | 8/2000 |
| WO | WO-00/53722 | 9/2000 |
| WO | WO-01/29058 | 4/2001 |
| WO | WO-01/36646 | 5/2001 |
| WO | WO-01/75164 | 10/2001 |
| WO | WO-02/08754 | 1/2002 |
| WO | WO-03/046185 | 6/2003 |
| WO | WO-03/047518 | 6/2003 |
| WO | WO-2004/013280 | 2/2004 |
| WO | WO-2004/045543 | 6/2004 |
| WO | WO-2004/083430 | 9/2004 |
| WO | 2005001043 A2 | 1/2005 |
| WO | WO-2006/047842 | 5/2006 |
| WO | WO-2006/068232 | 6/2006 |
| WO | WO-2009/036368 | 3/2009 |
| WO | 2009044392 A2 | 4/2009 |
| WO | WO-2009/116257 | 9/2009 |
| WO | WO-2010/014117 | 2/2010 |
| WO | WO-2010/026766 | 3/2010 |
| WO | WO-2011/066475 | 6/2011 |
| WO | WO-2011/084193 | 7/2011 |
| WO | WO-2011/085056 | 7/2011 |
| WO | 2012170957 A2 | 12/2012 |

OTHER PUBLICATIONS

Schwarz et al. (Cell, vol. 115, 2003: 199-208).*
Stetler et al. (Curr. Mol. Med. 2009; 9:863-872).*
Vidyasagar et al. (Kidney International 2012: 83: 84-92).*
Higuchi et al. (Neuromuscular Disorders 17, 2007: 221-226).*
Abe, et al. Interstitial expression of heat shock protein 47 and a-smooth muscle actin in renal allograft failure, Nephrol Dial Transplant (2000), 15:529-535.
Allart, et al., 1,5-Anhydro-2-Deoxy-D-Altritol Oligonucleotides as Conformationally Restricted Analogues of Rna, Nucleosides & Nucleotides, (1998), 17:1523-1526.
Amarzguioui, et al., Tolerance for mutations and chemical modifications in a siRNA, Nucleic Acids Research, (2003), 31(2):589-595.
Bahramian, et al., Transcriptional and Posttranscriptional Silencing of Rodent Alpha 1(I) Collagen by a Homologous Transcriptionally Self-Silenced Transgene, Molecular and Cellular Biology, (1999), 19:274-283.
Bass, Double-Stranded RNA as a Template for Gene Silencing, Cell, (2000), 101:235-238.
Brown, et al., Expression of HSP47, a collagen-specific chaperone, in normal and diseased human liver, Laboratory Investigation (2005) 85:789-797.
Chen, et al., Multitarget-ribozyme directed to cleave at up to nine highly conserved HIV-1 env RNA regions inhibits HIV-1 replication-potential effectiveness against most presently sequenced HIV-1 isolates, Nucleic Acids Res., (1992), 20(17):4581-4589.
Chen, et al., Effect of heat shock protein 47 on collagen accumulation in keloid fibroblast cells, British Journal of Dermatology, (2007), 156:1188-1195.
Chen, et al., Expression of ZAP-70 is associated with increased B-cell receptor signaling in chronic lymphocytic leukemia, Blood, (2002), 100(13):4609-4614.
Choi, et al., Effect of Poly(ethylene glycol) Grafting on Polyethylenimine as a Gene Transfer Vector in vitro, Bull. Korean Chem. Soc., (2001), 22(1):46-52.
Chowrira, et al., In Vitro and in Vivo Comparison of Hammerhead Hairpin, and Hepatitis Delta Virus Self-processing Ribozyme Cassettes, J. Biol. Chem, (1994), 269:25856.
Chua, et al.,Pulmonary Fibrosis, Searching for Model Answers, American J. Respir. Cell Mol. Biology, (2005), 33:9-13.
Cload, et al., Polyether Tethered Oligonucleotide Probes, J. Am. Chem. Soc., (1991), 113:6324-6326.
Conry, et al., Phase I Trial of a Recombinant Vaccinia Virus Encoding Carcinoembryonic Antigen in Metastatic Adenocarcinoma: Comparison of Intradermal versus Subcutaneous Administration, Clin. Cancer Res., (1999), 5:2330-2337.
Cordeiro, et al., Human Anti-Transforming Growth Factor-Beta2 Antibody: A New Glaucoma Anti-Scarring Agent, Invest. Ophthalmol. & Vis. Sci., (1999), 40(I0):2225-2234.
Crinelli, et al., Design and characterization of decoy oligonucleotides containing locked nucleic acids, Nucl Acid Res., (2002), 30(11):2435-2443.
Czauderna, et al., Structural variations and stabilising modifications of synthetic siRNAs in mammalian cells, Nucleic Acids Res., (2003), 31(11):2705-2716.
Diebold, et al., Mannose Polyethylenimine Conjugates for Targeted DNA Delivery into Dendritic Cells, Journal of Biological Chemistry, (1999), 274:19087-19094.
Dropulic, et al., Functional Characterization of U5 Ribozyme: Intracellular Suppression of Human Immunodeficiency Virus Type 1 Expression, J. Virol., (1992), 66:1432-1441.
Durand, et al., Circular dichroism studies of an oligodeoxyribonucleotide containing a hairpin loop made of a hexaethylene glyco chain: conformation and stability, Nucleic Acids Res., (1990), 18:6353-6359.
Elbashir, et al., Functional anatomy of siRNAs for mediating efficient RNAi in *Drosophila melanogaster* embryo lysate, EMBO J., (2001), 20:6877-6888.
Elbashir, et al., RNA interference is mediated by 21- and 22-nucleotide RNAs, Genes Dev., (2001), 15:188-200.
Elroy-Stein, et al., Cytoplasmic expression system based on constitutive synthesis of bacteriophage T7 RNA polymerase in mammalian cells, Proc. Nat. Acad. Sci., (1990), 87:6743-6747.
Erbacher et al., Transfection and Physical Properties of Various Saccharide, Poly(ethylene glycol), and Antibody-Derivatized Polyethylenimines (PEI), J Gene Med., (1999), 1:210-222.
Ferentz, et al., Disulfide-crosslinked oligonucleotides, J. Am. Chem. Soc., (1991), 113(10):4000-4002.
Fire, et al., Potent and specific genetic interference by double-stranded RNA in *Caenorhabditis elegans*, Nature, (1998), 391:806-811.
Freier, et al., Improved free-energy parameters for predictions of RNA duplex stability, Proc. Nat. Acad. Sci., (1986), 83:9373-9377.
Gao et al., Cytoplasmic expression of a reporter gene by co-delivery of T7 RNA polymerase and T7 promoter sequence with cationic liposomes, Nucleic Acids Res., (1993), 21:2867-2872.
Godbey, et al., Tracking the intracellular path of poly(ethylenimine)/DNA complexes for gene delivery, PNAS USA, (1999), 96:5177-5181.
Good, et al., Expression of small, therapeutic RNAs in human cell nuclei, Gene Ther., (1997), 4:45-54.
Gross, et al., Idiopathic Pulmonary Fibrosis, New England J. Med., (2001), 345(7):517-525.
Hagiwara, et al., An antisense oligonucleotide to HSP47 inhibits paraquat-induced pulmonary fibrosis in rats, Toxicology,(2007) 236:199-207.
Hagiwara,et al., Antisense oligonucleotide inhibition of Heat Shock Protein (HSP) 47 improves bleomycin-induced pulmonary fibrosis in rats, Respiratory Research (2007) 8:37 (pp. 1-11).
Hammond, et al., An RNA-directed nuclease mediates post-transcriptional gene silencing in *Drosophila* cells, Nature, (2000), 404: 293-296.

(56) References Cited

OTHER PUBLICATIONS

Howard, et al, Wound Healing-Associated Proteins Hsp47 and Fibronectin Are Elevated in Dupuytren's Contracture, Journal of Surgical Research (2004) 117:232-238.
International Search Report and Written Opinion from PCT Publication No. WO2006/068232 (PCT/JP2006/023619) dated Jun. 22, 2006.
International Search Report dated Jun. 20, 2011 in Application No. PCT/US2010/059578.
Ishiwata, et al., Physical-Chemistry Characteristics and Biodistribution of Poly(ethylene glycol)-Coated Liposomes Using Poly(oxyethylene) Cholesteryl Ether, Chem. Pharm. Bull., (1995), 43(6):1005-1011.
Iwashita, et al., Involvement of Collagen-Binding Heat Shock Protein 47 and Procollagen Type I Synthesis in Idiopathic Pulmonary Fibrosis: Contribution of Type II Pneumocytes to Fibrosis, Hum Pathol (2000) 31:1498-1505.
Jaschke, et al., Automated incorporation of polyethylene glycol into synthetic oligonucleotides, Tetrahedron Lett., (1993), 34(2):301-304.
Jayasena, Aptamers: An Emerging Class of Molecules That Rival Antibodies in Diagnostics, Clinical Chemistry, (1999), 45(9):1628-1650.
Jensen et al, Unlocked nucleic acid (UNA) and UNA derivatives: Thermal denaturation studies, Nucleic Acids Symposium, (2008), 52:133-134.
Kakugawa, et al., Pirfenidone attenuates expression of HSP47 in murine bleomycin-induced pulmonary fibrosis, Eur. Respir. J., (2004), 24:57-65.
Koide, et al., Specific Recognition of the Collagen Triple Helix by Chaperone HSP47, J. Biol. Chem., (2006), 281:3432-3438.
Koide, et al., Sustrate Recognition of Collagen-specific Molecular Chaperone HSP47, J. Biol. Chem., (1999), 274:34523-34526.
Krishnamurthy, et al., Inhibition of matrix metalloproteinases improves left ventricular function in mice lacking osteopontin after myocardial infarction, Mol Cell Biochem. (2009) 322:53-62.
Kubota, et al., Roles of collagen fibers and its specific molecular chaperone: analysis using HSP47-knockout mice, (2004) 3:118-9.
Kurreck, et al., Design of antisense oligonucleotides stabilized by locked nucleic acids, Nucl. Acids Res., (2002), 30(9):1911-1918.
Lasky, Interstitial Fibrosis and Growth Factors, Environ. Health Perspect., (2000), 108 Supp.(4):751-762.
L'Huillier, et al., Cytoplasmic delivery of ribozymes leads to efficient reduction in alpha-lactalbumin mRNA levels in C127I mouse cells, EMBO J., (1992), 11:4411-4418.
Lindsey, et al., Temporal and Spatial Expression of Matrix Metalloproteinases and Tissue Inhibitors of Metalloproteinases Following Myocardial Infarction, Cardiovasc. Ther. Jul. 14, 2010 [Epub ahead of print].
Lindsey, MMP induction and inhibition in myocardial infarction, Heart Fail Rev (2004) 9:7-19.
Lisziewicz, et al., Inhibition of human immunodeficiency virus type 1 replication by regulated expression of a polymeric Tat activation response RNA decoy as a strategy for gene therapy in AIDS, Proc. Natl. Acad. Sci., (1993), 90:8000-8004.
Ma, et al., Design and synthesis of RNA miniduplexes via a synthetic linker approach, Biochemistry, (1993), 32(7): 1751-1758.
Ma, et al., Design and synthesis of RNA miniduplexes via a synthetic linker approach. 2. Generation of covalenty closed, double-stranded cyclic HIV-1 TAR RNA analogs with high Tat-binding affinity, Nucleic Acids Res., (1993), 21(11):2585-2589.
Maeda, et al., A Novel Neuroprotectant against Retinal Ganglion Cell Damage in a Glaucoma Model and an Optic Nerve Crush Model in the Rat, Investigative Ophthalmology and Visual Science, (2004), 45(3):851-856.
Maher, Lost in translation; from animal models of pulmonary fibrosis to human disease, Respirology (2009) 14:915-916.
Manabe, et al., Gene Expression in Fibroblasts and Fibrosis: Involvement in Cardiac Hypertrophy, Circ Res., (2002), 91(12):1103-1113.

Masuda, et al., Coexpression of the Collagen-binding Stress Protein HSP47 Gene and the Alpha1(I) and the Alpha1(III) Collagen Genes in Carbon Tetrachloride-induced Rat Liver Fibrosis, J. Clin. Invest., (1994), 94:2481-2488.
Masuda, et al., Expression and localization of collagen-binding stress protein Hsp47 in mouse embryo development: comparison with types I and II collagen, Cell Stress Chaperones, (1998), 3:256-264.
McCurdy, et al., Deoxyoligonucleotides with Inverted Polarity Synthesis and Use in Triple-Helix Formation, Nucleosides & Nucleotides, (1991), 10(1-3):287-290.
McGarry, Inhibition of heat shock protein synthesis by heat-inducible antisense RNA, Proc. Natl. Acad. Sci., (1986), 83:399-403.
McManus, et al., Gene silencing using micro-RNA designed hairpins, RNA, (2002), 8:842-850.
Moeller, et al., The bleomycin animal model: a useful tool to investigate treatment options for idiopathic pulmonary fibrosis? Int. J. Biochem. Cell Biol., (2008), 40:362-382.
Molina, et al.,Fibrotic Diseases, Harefuah, (2002), 141(11):973-978, 1009.
Moriyama, et al., Up-regulation of HSP47 in the mouse kidneys with unilateral ureteral obstruction, Kidney Int., (1998), 54:110-119.
Nagata, Hsp47: a collagen-specific molecular chaperone, Trends Biochem Sci, (1996), 21:22-6.
Noonberg, et al., In vivo generation of highly abundant sequence-specific oligonucleotides for antisense and triplex gene regulation, Nucleic Acid Res., (1994), 22:2830-2836.
Ogris, et al., DNA/polyethylenimine transfection particles: Influence of ligands, polymer size, and PEGylation on internalization and gene expression, AAPA PharmSci,(2001), 3(3):1-11.
Ohashi,et al, Advanced Glycation End Products Increase Collagen-specific Chaperone Protein in Mouse Diabetic Nephropathy,(2004) The Journal of Biological Chemistry, 279:19816-19823.
Ohba, et al., Interstitial expression of heat-shock protein 47 correlates with capillary deposition of complement split product C4d in chronic allograft nephropathy, Clin Transplant (2005) 19:810-816.
Ojwang, et al., Inhibition of human immunodeficiency virus type 1 expression by a hairpin ribozyme, Proc. Natl. Acad. Sci., (1992), 89:10802-10806.
Ono et al., DNA triplex formation of oligonucleotide analogues consisting of linker groups and octamer segments that have opposite sugar-phosphate backbone polarities, Biochemistry, (1991), 30(41):9914-2.
Onuma, et al., Correlation between the Airway Branching Patterns and the Heterogeneous Distribution of the Lesions in Bleomycin-Injured Mouse Lung: A 3-D Morphometric Study, Tohoku J. Exp. Med. (2001), 194:147-156.
Perez-Perez, et al., Synthesis and antiviral activity of 2-deoxy-1,5-anhydro-D-mannitol nucleosides containing a pyrimidline base moiety, Bioorg. and Medicinal Chem Letters, (1996), 6(13):1457-1460.
Prakash, et al., Positional Effect of Chemical Modifications on Short Interference RNA Activity in Mammalian Cells, J. Med. Chem., (2005), 48:4247-4253.
Razzaque, et al., Role of Collagen-Binding Heat Shock Protein 47 and Transforming Growth Factor-B1 in Conjunctival Scarring in Ocular Cicatricial Pemphigoid, IOVS (2003) 44:1616-1621.
Reinhart, et al., MicroRNAs in plants, Gene & Dev., (2002), 16:1616-1626.
Reinhart, et al., Small RNAs Correspond to Centromere Heterochromatic Repeats, Science, (2002), 297:1831.
Richardson, et al., Tethered oligonucleotide probes. A strategy for the recognition of structured RNA, J. Am. Chem. Soc., (1991), 113(13):5109-5111.
Sasaki, et al., Induction of Heat Shock Protein 47 Synthesis by TFG-β and IL-1β Via Enhancement of the Heat Shock Element Binding Activity of Heat Shock Transcription Factor 1, (2002), 168:5178-5183.
Sato, et al., Resolution of liver cirrhosis using vitamin A-coupled liposomes to deliver siRNA against a collagen-specific chaperone, Nature Biotechnology, (2008), 26(4):431-442.
Sauk, et al., Hsp47 a novel collagen binding serpin chaperone, autoantigen and therapeutic target, Front Biosci (2005) 10:107-18.

(56) References Cited

OTHER PUBLICATIONS

Scanlon, et al., Ribozyme-mediated cleavage of c-fos mRNA reduces gene expression of DNA synthesis enzymes and metallothionein, Proc. Natl. Acad. Sci., (1991), 88:10591-10595.
Seela, et al., Oligodeoxyribonucleotides containing 1,3-propanediol as nucleoside substitute, Nucleic Acids Res., (1987), 15(7):3113-3129.
Sharp, RNAi and double-strand RNA, Genes & Dev., (1999), 13:139-141.
Shimizukawa, et al., Intratracheal gene transfer of decorin reduces subpleural fibroproliferation induced by bleomycin, Am. J. Physiol. Lung Cell Mol Physio., (2003), 284:L526-L532.
Smirnov, et al., Strong expression of HSP47 in metaplastic nasal mucosa may predict a poor outcome after primary endoscopic dacryocystorhinostomy: a prospective study, Acta Ophthalmologica (2009) (Article first published online Sep. 24, 2009).
Sommer, et al., The Spread and Uptake Pattern of Intracerebrally Administered Oligonucleotides in Nerve and Glial Cell Populations of the Rat Brain, Antisense & Nuc. Acid Drug Dev., (1998), 8:75-85.
Swiderski, et al., Differential Expression of Extracellular Matrix Remodeling Genes in a Murine Model of Bleomycin-Induced Pulmonary Fibrosis, Am. J. Pathol., (1998), 152:821-828.
Taira et al., Construction of a novel RNA-transcript-trimming plasmid which can be used both in vitro in place of run-off and (G)-free transcriptions and in vivo as multi-sequences transcription vectors, Nucleic Acids Res., (1991), 19:5125-5130.
Takeda,et al., Greather than normal expression of the collagen-binding stress protein heat-shock protein-47 in the infarct zone in rats after experimentally-induced myocardial infarction, Coron Artery Dis (2000) 11:57-68.
Thomas, et al., Enhancing polyethylenimine's delivery of plasmid DNA into mammalian cells, PNAS USA, (2002), 99:14640-14645.
Thompson, et al., Improved Accumulation and Activity of Ribozymes Expressed from a tRNA-based RNA polymerase III Promoter, Nucleic Acids Res., (1995), 23:2259-2268.
Ventura, et al., Activation of HIV-specific Ribozyme Activity by Self-Cleavage, Nucleic Acids Res., (1993), 21:3249-3255.
Volpe, et al., Regulation of Heterochromatic Silencing and Histone H3 Lysine-9 Methylation by RNAi, Science, (2002), 297:1833-1837.
Wahlestedt, et al., Potent and nontoxic antisense oligonucleotides containing locked nucleic acids, PNAS, (2000), 97(10):5633-5638.
Watanabe, et al., Treatment of Idiopathic Myelofibrosis Employing siRNA for Heat Shock Protein 47 (siRNA/HSP47) Encapsulated in Liposomes, Blood (ASH Annual Meeting Abstracts), (2007) 110: Abract 4646.
Weerasinghe, et al., Resistance to Human Immunodeficiency Virus Type 1 (HIV-1) Infection in Human CD4+ Lymphocyte-Derived Cell Lines Conferred by Using Retroviral Vectors Expressing an HIV-1 RNA-Specific Ribozyme, Journal of Virology, 65:5531-5534 (1991).
Xia, et al., Suppression of renal tubulointerstitial fibrosis by small interfering RNA targeting heat shock protein 47, Am J Nephrol (2008) 28:34-46.
Yasufuku, et al., Oral Tolerance Induction by Type V Collagen Downregulates Lung Allograft Rejection, Am. J. Respir. Cell Mol. Bio., (2001) 25:26-34.
Yu, et al., A Hairpin Ribozyme Inhibits Expression of Diverse Strains of Human Immunodeficiency Virus Type 1, Proc. Natl. Acad. Sci., (1993) 90:6340-6344.
Zamore, et al., RNAi: Double-Stranded RNA Directs the ATP-Dependent Cleavage of mRNA at 21 to 23 Nucleotide Intervals, Cell, (2000), 101:25-33.
Zhou, et al, Synthesis of Functional mRNA in Mammalian Cells by Bacteriophage T3 RNA Polymerase, Mol. Cell Bio., (1990) 10:4529-4537.
First Office Action and English translation thereof issued Oct. 26, 2011, in connection with Chinese Application No. 200980109550.4, a Chinese national phase application of WO2009/116257.
Kawada N., et al., "Expression of heat-shock protein 47 in mouse liver", Cell Tissue Res. (1996); 284(2):341-6.
Miao Li-yun et al., "Heat Shock Protein 47 and pulmonary fibrosis", International Journal of Respiration, (2007); 27 (22): 1745-1747 (English Abstract).
Supplementary European Search Report issued in EP 10836656 dated Apr. 22, 2013.
Du et al., A systematic analysis of the silencing effects of an active siRNA at all single-nucleotide mismatched target sites. Nucleic Acids Res. Mar. 21, 2005;33(5):1671-1677.
Wang and Li, Adenovirus-mediated RNA interference against collagen-specific molecular chaperone 47-KDa heat shock protein suppresses scar formation on mouse wounds. Cell Biol Int. May 2008;32(5):484-493.
Office Action and Search Report issued by SIPO in PRC Patent Application No. 201080060946.7 dated Apr. 15, 2013 (includes English Translation).
Office Action issued in corresponding Australian Patent Application No. 2010328104, dated Nov. 8, 2013.
Ui-Tei et al., "Functional dissection of siRNA sequence by systematic DNA substitution: modified siRNA with a DNA seed arm is a powerful tool for mammalian gene silencing with significantly reduced off-target effect", Nucleic Acids Research, 2008, 36(7):2136-2151.

\* cited by examiner

Treatment:
1. cells only
2. RNAiMAX
3. RNAiMAX + scrambled siRNA
4. RNAiMAX + siGFP FIGURE 2 (continued)
C
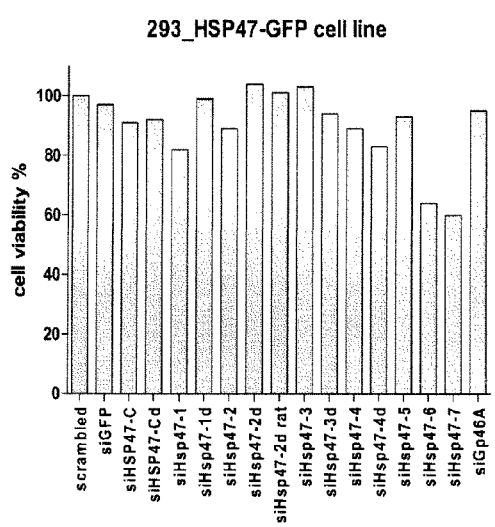
D
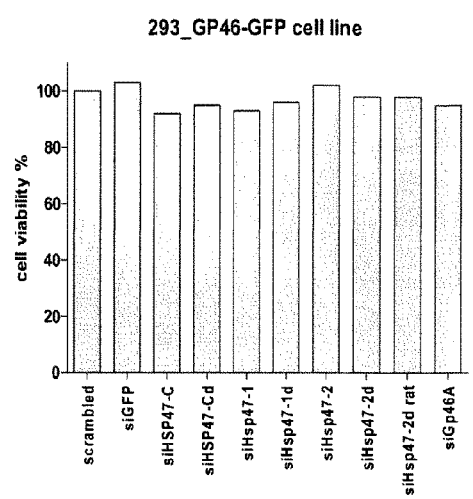

FIGURE 6 (mRNA based on the NM_001235 cDNA sequence)

```
   1 ucuuuggcuu uuuuuggcgg agcuggggcg cccuccggaa gcguuuccaa cuuuccagaa
  61 guuucucggg acgggcagga ggggguggggg acugccauau auagaucccg ggagcagggg
 121 agcgggcuaa gaguagaauc gugucgcggc ucgagagcga gagucacguc ccggcgcuag
 181 cccagcccga cccaggccca ccguggugca cgcaaaccac uuccuggcca ugcgcucccu
 241 ccugcuucuc agcgccuucu gccuccugga ggcggcccug gccgcgagg ugaagaaacc
 301 ugcagccgca gcagcuccug gcacugcgga gaaguugagc cccaaggcgg ccacgcuugc
 361 cgagcgcagc gccggccugg ccuucagcuu guaccaggcc auggccaagg accaggcagu
 421 ggagaacauc cuggugucac ccgugguggu ggccucgucg cuagggcucg ugucgcuggg
 481 cggcaaggcg accacggcgu cgcaggccaa ggcagugcug agcgccgagc agcugcgcga
 541 cgaggagguc cacgccggcc ugggcgagcu gcugcgcuca cucagcaacu ccacggcgcg
 601 caacgugacc uggaagcugg gcagccgacu guacggaccc agcucaguga gcuucgcuga
 661 ugacuucgug cgcagcagca agcagcacua caacgcgag cacuccaaga ucaacuuccg
 721 cgacaagcgc agcgcgcugc aguccaucaa cgaguggcc gcgcagacca ccgacggcaa
 781 gcugcccgag gucaccaagg acguggagcg cacggacggc gcccugcuag ucaacgccau
 841 guucuucaag ccacacuggg augagaaauu ccaccacaag augguggaca ccguggcuu
 901 cauggugacu cgguccuaua ccguggugu caugaugaug caccggacag gccucuacaa
 961 cuacuacgac gacgagaagg aaaagcugca aaucguggag augcccugg cccacaagcu
1021 cuccagccuc aucauccuca ugccccauca cguggagccu cucgagcgcc uugaaaagcu
1081 gcuaaccaaa gagcagcuga agaucuggau ggggaagaug cagaagaagg cuguugccau
1141 cuccuugccc aagggugugg uggaggugac ccaugaccug cagaaacacc uggcugggcu
1201 gggccugacu gaggccauug acaagaacaa ggccgacuug ucacgcaugu caggcaagaa
1261 ggaccuguac cuggccagcg uguuccagc caccgccuuu gaguuggaca cagauggcaa
1321 cccccuuugac caggacaucu acgggcgcga ggagcugcgc agccccaagc uguucuacgc
1381 cgaccacccc uucaucuucc uagugcggga cacccaaagc ggcucccugc uauucauugg
1441 gcgccugguc cggccuaagg gugacaagau gcgagacgag uuauagggcc ucagggugca
1501 cacaggaugg caggaggcau ccaaaggcuc cugagacaca uggggucuau uggggunggg
1561 ggggaggnga gguaccagcc uuggauacuc caugggugg ggnggaaaaa acagaccggg
1621 guucccgugu gccugagcgg accuucccag cuagaauuca cuccacunugg acaugggccc
1681 cagauaccau gaugcugagc ccggaaacuc cacauccgu gggaccnggg ccauagucau
1741 ucugccugcc cugaaagucc cagaucaagc cugccucaau caguauucau auuuauagcc
1801 agguaccuuc ucaccuguga gaccaaauug agcuagggg gucagccagc ccucuucuga
1861 cacuaaaaca ccucagcugc cuccccagcu cuauccccac cucucccaac uauaaaaacua
1921 ggugcugcag ccccugggac caggcaccc cagaaugacc uggccgcagu gaggcggauu
1981 gagaaggagc ucccaggagg ggcuucuggg cagacucugg ucaagaagca ucguguggg
2041 cguuguggg augaacuuuu uguuuuguuu cuuccuuuuu uaguucuuca aagauaggga
2101 gggaagggg aacaugagcc uuuguugcua ucaauccaag aacuuauuug uacauuuuuu
2161 uuuucaauaa aacuuuucca augacauuuu guuggagcgu ggaaaaaa (SEQ ID NO: 1)
```

FIGURE 7 (protein sequence NP_001226)

```
  1 MRSLLLLSAF CLLEAALAAE VKKPAAAAAP GTAEKLSPKA ATLAERSAGL AFSLYQAMAK
 61 DQAVENILVS PVVVASSLGL VSLGGKATTA SQAKAVLSAE QLRDEEVHAG LGELLRSLSN
121 STARNVTWKL GSRLYGPSSV SFADDFVRSS KQHYNCEHSK INFRDKRSAL QSINEWAAQT
181 TDGKLPEVTK DVERTDGALL VNAMFFKPHW DEKFHHKMVD NRGFMVTRSY TVGVMMMHRT
241 GLYNYYDDEK EKLQIVEMPL AHKLSSLIIL MPHHVEPLER LEKLLTKEQL KIWMGKMQKK
301 AVAISLPKGV VEVTHDLQKH LAGLGLTEAI DKNKADLSRM SGKKDLYLAS VFHATAFELD
361 TDGNPFDQDI YGREELRSPK LFYADHPFIF LVRDTQSGSL LFIGRLVRPK GDKMRDEL
    (SEQ ID NO: 2)
```

FIGURE 8 (Coding Sequence of NM_001235)

```
   1 atgcgctccc tcctgcttct cagcgccttc tgcctcctgg aggcggccct ggccgccgag
  61 gtgaagaaac ctgcagccgc agcagctcct ggcactgcgg agaagttgag ccccaaggcg
 121 gccacgcttg ccgagcgcag cgccggcctg gccttcagct tgtaccaggc catggccaag
 181 gaccaggcag tggagaacat cctggtgtca cccgtggtgg tggcctcgtc gctagggctc
 241 gtgtcgctgg gcggcaaggc gaccacggcg tcgcaggcca aggcagtgct gagcgccgag
 301 cagctgcgcg acgaggaggt gcacgccggc ctgggcgagc tgctgcgctc actcagcaac
 361 tccacggcgc gcaacgtgac ctggaagctg ggcagccgac tgtacggacc cagctcagtg
 421 agcttcgctg atgacttcgt gcgcagcagc aagcagcact acaactgcga gcactccaag
 481 atcaacttcc gcgacaagcg cagcgcgctg cagtccatca acgagtgggc cgcgcagacc
 541 accgacggca agctgcccga ggtcaccaag gacgtggagc gcacggacgg cgccctgcta
 601 gtcaacgcca tgttcttcaa gccacactgg gatgagaaat tccaccacaa gatggtggac
 661 aaccgtggct tcatggtgac tcggtcctat accgtgggtg tcatgatgat gcaccggaca
 721 ggcctctaca actactacga cgacgagaag gaaaagctgc aaatcgtgga gatgcccctg
 781 gcccacaagc tctccagcct catcatcctc atgccccatc acgtggagcc tctcgagcgc
 841 cttgaaaagc tgctaaccaa agagcagctg aagatctgga tggggaagat gcagaagaag
 901 gctgttgcca tctccttgcc caagggtgtg gtggaggtga cccatgacct gcagaaacac
 961 ctggctgggc tgggcctgac tgaggccatt gacaagaaca aggccgactt gtcacgcatg
1021 tcaggcaaga aggacctgta cctggccagc gtgttccacg ccaccgcctt tgagttggac
1081 acagatggca accccttga ccaggacatc tacgggcgcg aggagctgcg cagccccaag
1141 ctgttctacg ccgaccaccc cttcatcttc ctagtgcggg acacccaaag cggctccctg
1201 ctattcattg ggcgcctggt ccggcctaag ggtgacaaga tgcgagacga gttatag
    (SEQ ID NO: 59)
```

MODULATION OF HSP47 EXPRESSION

RELATED PATENT APPLICATIONS

This application claims the benefit of U.S. Provisional Application Ser. Nos. 61/372,072, filed Aug. 9, 2010, 61/307,412, filed Feb. 23, 2010 and 61/285,149, filed Dec. 9, 2009 each entitled "Modulation of HSP47 Expression" and which are incorporated herein by reference in their entirety and for all purposes.

SEQUENCE LISTING

The instant application contains a Sequence Listing which is entitled 220-PCT1_ST25_07Dec-10.txt, said ASCII copy, created on Dec. 7, 2010 and is 533 kb in size, is hereby incorporated by reference in its entirety.

FIELD OF THE INVENTION

Provided herein are compositions and methods for modulating expression of hsp47.

BACKGROUND OF THE INVENTION

Sato, Y., et al. disclose the administration of vitamin A-coupled liposomes to deliver small interfering RNA (siRNA) against gp46, the rat homolog of human heat shock protein 47, to liver cirrhosis rat animal models. Sato, Y., et al., Nature Biotechnology, vol. 26 (4), p. 431-442 (2008).

Chen, J-J., et al. disclose transfecting human keloid samples with HSP47-shRNA (small hairpin RNA) to examine proliferation of keloid fibroblast cells. Chen, J-J., et al., British Journal of Dermatology, vol. 156, p. 1188-1195 (2007).

PCT Patent Publication No. WO 2006/068232 discloses an astrocyte specific drug carrier which includes a retinoid derivative and/or a vitamin A analog.

SUMMARY OF THE INVENTION

Compositions, methods and kits for modulating expression of target genes are provided herein. In various aspects and embodiments, compositions, methods and kits provided herein modulate expression of heat shock protein 47 (hsp47), also known as SERPINH1. The compositions, methods and kits may involve use of nucleic acid molecules (for example, short interfering nucleic acid (siNA), short interfering RNA (siRNA), double-stranded RNA (dsRNA), micro-RNA (miRNA) or short hairpin RNA (shRNA)) that bind a nucleotide sequence (such as an mRNA sequence) encoding hsp47, for example, the mRNA coding sequence for human hsp47 exemplified by SEQ ID NO:1. In certain preferred embodiments, the compositions, methods and kits disclosed herein inhibit expression of hsp47. For example, siNA molecules (e.g., RISC length dsNA molecules or Dicer length dsNA molecules) are provided that reduce or inhibit hsp47 expression. Also provided are compositions, methods and kits for treating and/or preventing diseases, conditions or disorders associated with hsp47, such as liver fibrosis, cirrhosis, pulmonary fibrosis including lung fibrosis (including ILF), kidney fibrosis resulting from any condition (e.g., CKD including ESRD), peritoneal fibrosis, chronic hepatic damage, fibrillogenesis, fibrotic diseases in other organs, abnormal scarring (keloids) associated with all possible types of skin injury accidental and jatrogenic (operations); scleroderma; cardiofibrosis, failure of glaucoma filtering operation; and intestinal adhesions.

In one aspect, provided are nucleic acid molecules (e.g., siNA molecules) in which (a) the nucleic acid molecule includes a sense strand and an antisense strand; (b) each strand of the nucleic acid molecule is independently 15 to 49 nucleotides in length; (c) a 15 to 49 nucleotide sequence of the antisense strand is complementary to a sequence of an mRNA encoding human hsp47 (e.g., SEQ ID NO: 1); and (d) a 15 to 49 nucleotide sequence of the sense strand is complementary to the a sequence of the antisense strand and includes a 15 to 49 nucleotide sequence of an mRNA encoding human hsp47 (e.g., SEQ ID NO: 1).

In certain embodiments, the sequence of the antisense strand that is complementary to a sequence of an mRNA encoding human hsp47 includes a sequence complimentary to a sequence between nucleotides 600-800; or 801-899; or 900-1000; or 1001-1300 of SEQ ID NO: 1; or between nucleotides 650-730; or 900-975 of SEQ ID NO: 1. In some embodiments, the antisense strand includes a sequence that is complementary to a sequence of an mRNA encoding human hsp47 corresponding to nucleotides 674-693 of SEQ ID NO: 1 or a portion thereof; or nucleotides 698-716 of SEQ ID NO: 1 or a portion thereof; or nucleotides 698-722 of SEQ ID NO: 1 or a portion thereof; or nucleotides 701-720 of SEQ ID NO: 1 or a portion thereof; or nucleotides 920-939 of SEQ ID NO: 1 or a portion thereof; or nucleotides 963-982 of SEQ ID NO: 1 or a portion thereof; or nucleotides 947-972 of SEQ ID NO: 1 or a portion thereof; or nucleotides 948-966 of SEQ ID NO: 1 or a portion thereof; or nucleotides 945-969 of SEQ ID NO: 1 or a portion thereof; or nucleotides 945-963 of SEQ ID NO: 1 or a portion thereof.

In certain embodiments, the antisense strand of a nucleic acid molecule (e.g., a siNA molecule) as disclosed herein includes a sequence corresponding to SEQ ID NO: 4 or a portion thereof; or SEQ ID NO: 6 or a portion thereof; or SEQ ID NO: 8 or a portion thereof; or SEQ ID NO: 10 or a portion thereof; or SEQ ID NO: 12 or a portion thereof; or SEQ ID NO: 14 or a portion thereof; or SEQ ID NO: 16 or a portion thereof; or SEQ ID NO: 18 or a portion thereof; or SEQ ID NO: 20 or a portion thereof; or SEQ ID NO: 22 or a portion thereof; or SEQ ID NO: 24 or a portion thereof; or SEQ ID NO: 26 or a portion thereof; or SEQ ID NO: 28 or a portion thereof; or SEQ ID NO: 30 or a portion thereof; or SEQ ID NO: 32 or a portion thereof; or SEQ ID NO: 34 or a portion thereof; or SEQ ID NO: 36 or a portion thereof; or SEQ ID NO: 38 or a portion thereof; or SEQ ID NO: 40 or a portion thereof; or SEQ ID NO: 42 or a portion thereof; or SEQ ID NO: 44 or a portion thereof; or SEQ ID NO: 46 or a portion thereof; or SEQ ID NO: 48 or a portion thereof; or SEQ ID NO: 50 or a portion thereof; or SEQ ID NO: 52 or a portion thereof; or SEQ ID NO: 54 or a portion thereof; or SEQ ID NO: 56 or a portion thereof; or SEQ ID NO: 58 or a portion thereof. In certain embodiments, the sense strand of a nucleic acid molecule (e.g., a siNA molecule) as disclosed herein includes a sequence corresponding to SEQ ID NO: 3 or a portion thereof; or SEQ ID NO: 5 or a portion thereof; or SEQ ID NO: 7 or a portion thereof; or SEQ ID NO: 9 or a portion thereof; or SEQ ID NO: 11 or a portion thereof; or SEQ ID NO: 13 or a portion thereof; or SEQ ID NO: 15 or a portion thereof; or SEQ ID NO: 17 or a portion thereof; or SEQ ID NO: 19 or a portion thereof; or SEQ ID NO: 21 or a portion thereof; or SEQ ID NO: 23 or a portion thereof; or SEQ ID NO: 25 or a portion thereof; or SEQ ID NO: 27 or a portion thereof; or SEQ ID NO: 29 or a portion thereof; or SEQ ID NO: 31 or a portion thereof; or SEQ ID NO: 33 or a portion thereof; or SEQ ID NO: 35 or a portion thereof; or SEQ ID NO: 37 or a portion thereof; or SEQ ID NO: 39 or a portion thereof; or SEQ ID NO: 41 or a portion thereof; or SEQ ID NO: 43 or a portion thereof; or SEQ ID NO: 45 or a portion thereof; or SEQ ID NO: 47 or a portion thereof; or SEQ ID NO: 49 or a portion thereof; or SEQ ID NO: 51 or a portion thereof; or SEQ ID NO: 53 or a portion thereof; or SEQ ID NO: 55 or a portion thereof; or SEQ ID NO: 57 or a portion thereof.

In certain preferred embodiments, the antisense strand of a nucleic acid molecule (e.g., a siNA molecule) as disclosed herein includes a sequence corresponding to any one of the antisense sequences shown on Table A-19. In certain preferred embodiments the antisense strand and the strand are selected from the sequence pairs shown in Table A-19. In some embodiments the antisense and sense strands are selected from the sequence pairs set forth in SERPINH1_4, SERPINH1_12, SERPINH1_18, SERPINH1_30, SERPINH1_58 and SERPINH1_88. In some embodiments the antisense and sense strands are selected from the sequence pairs set forth in SERPINH1_4 (SEQ ID NOS:195 and 220), SERPINH1_12 (SEQ ID NOS:196 and 221), SERPINH1_30 (SEQ ID NOS:199 and 224), and SERPINH1_58 (SEQ ID NOS:208 and 233).

In some embodiments the antisense and sense strands of a nucleic acid molecule (e.g., a siNA molecule) as disclosed herein includes the sequence pairs set forth in SERPINH1_4 (SEQ ID NOS:195 and 220). In some embodiments of a nucleic acid molecule (e.g., a siNA molecule) as disclosed herein includes the antisense and sense strands of the sequence pairs set forth in SERPINH1_12 (SEQ ID NOS: 196 and 221). In some embodiments the antisense and sense strands of a nucleic acid molecule (e.g., a siNA molecule) as disclosed herein includes the sequence pairs set forth in SERPINH1_30 (SEQ ID NOS:199 and 224). In some embodiments of a nucleic acid molecule (e.g., a siNA molecule) as disclosed herein includes the antisense and sense strands of the sequence pairs set forth in SERPINH1_58 (SEQ ID NOS:208 and 233).

In certain embodiments, the antisense strand of a nucleic acid molecule (e.g., a siNA molecule) as disclosed herein includes a sequence corresponding to any one of the antisense sequences shown on any one of Tables B or C.

In certain preferred embodiments, the antisense strand of a nucleic acid molecule (e.g., a siNA molecule) as disclosed herein includes a sequence corresponding to any one of the antisense sequences shown on Table A-18. In certain preferred embodiments the antisense strand and the strand are selected from the sequence pairs shown in Table A-18. In some embodiments of a nucleic acid molecule (e.g., a siNA molecule) as disclosed herein includes the antisense and sense strands selected from the sequence pairs set forth in SERPINH1_2 (SEQ ID NOS: 60 and 127), SERPINH1_6 (SEQ ID NOS: 63 and 130), SERPINH1_11 (SEQ ID NOS: 68 and 135), SERPINH1_13 (SEQ ID NOS: 69 and 136), SERPINH1_45 (SEQ ID NOS: 97 and 164), SERPINH1_45a (SEQ ID NOS: 98 and 165), SERPINH1_51 (SEQ ID NOS: 101 and 168), SERPINH1_52 (SEQ ID NOS:102 and 169) or SERPINH1_86 (SEQ ID NOS: 123 and 190). In some preferred embodiments the antisense and sense strands are selected from the sequence pairs set forth in SERPINH1_2 (SEQ ID NOS: 60 and 127), SERPINH1_6 (SEQ ID NOS: 63 and 130). SERPINH1_45a (SEQ ID NOS: 98 and 165), and SERPINH1_51 (SEQ ID NOS: 101 and 168).

In some preferred embodiments of a nucleic acid molecule (e.g., a siNA molecule) as disclosed herein includes the antisense and sense strands selected from the sequence pairs set forth in SERPINH1_2 (SEQ ID NOS: 60 and 127). In some embodiments the antisense and sense strands include the sequence pairs set forth in SERPINH1_6 (SEQ ID NOS: 63 and 130). In some embodiments of a nucleic acid molecule (e.g., a siNA molecule) as disclosed herein includes the antisense and sense strands of the sequence pairs set forth in SERPINH1_11 (SEQ ID NOS: 68 and 135). In some embodiments the antisense and sense strands are the sequence pairs set forth in SERPINH1_13 (SEQ ID NOS: 69 and 136). In some embodiments the antisense and sense strands are the sequence pairs set forth in SERPINH1_45 (SEQ ID NOS: 97 and 164). In some embodiments the antisense and sense strands are the sequence pairs set forth in SERPINH1_45a (SEQ ID NOS: 98 and 165). In some embodiments the antisense and sense strands are the sequence pairs set forth in SERPINH1_51 (SEQ ID NOS: 101 and 168).

In certain embodiments, the antisense strand of a nucleic acid molecule (e.g., a siNA molecule) as disclosed herein includes a sequence corresponding to any one of the antisense sequences shown on any one of Tables D or E.

In various embodiments of nucleic acid molecules (e.g., siNA molecules) as disclosed herein, the antisense strand may be 15 to 49 nucleotides in length (e.g., 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48 or 49 nucleotides in length); or 17-35 nucleotides in length; or 17-30 nucleotides in length; or 15-25 nucleotides in length; or 18-25 nucleotides in length; or 18-23 nucleotides in length; or 19-21 nucleotides in length; or 25-30 nucleotides in length; or 26-28 nucleotides in length. In some embodiments of nucleic acid molecules (e.g., siNA molecules) as disclosed herein, the antisense strand may be 19 nucleotides in length Similarly the sense strand of nucleic acid molecules (e.g., siNA molecules) as disclosed herein may be 15 to 49 nucleotides in length (e.g., 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48 or 49 nucleotides in length); or 17-35 nucleotides in length; or 17-30 nucleotides in length; or 15-25 nucleotides in length; or 18-25 nucleotides in length; or 18-23 nucleotides in length; or 19-21 nucleotides in length; or 25-30 nucleotides in length; or 26-28 nucleotides in length. In some embodiments of nucleic acid molecules (e.g., siNA molecules) as disclosed herein, the sense strand may be 19 nucleotides in length. In some embodiments of nucleic acid molecules (e.g., siNA molecules) as disclosed herein, the antisense strand and the sense strand may be 19 nucleotides in length. The duplex region of the nucleic acid molecules (e.g., siNA molecules) as disclosed herein may be 15-49 nucleotides in length (e.g., about 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48 or 49 nucleotides in length), 15-35 nucleotides in length; or 15-30 nucleotides in length; or about 15-25 nucleotides in length; or 17-25 nucleotides in length; or 17-23 nucleotides in length; or 17-21 nucleotides in length; or 25-30 nucleotides in length; or 25-28 nucleotides in length. In various embodiments of nucleic acid molecules (e.g., siNA molecules) as disclosed herein, the duplex region may be 19 nucleotides in length.

In certain embodiments, the sense and antisense strands of a nucleic acid (e.g., an siNA nucleic acid molecule) as provided herein are separate polynucleotide strands. In some embodiments, the separate antisense and sense strands form a double stranded structure via hydrogen bonding, for example, Watson-Crick base pairing. In some embodiments the sense and antisense strands are two separate strands that are covalently linked to each other. In other embodiments, the sense and antisense strands are part of a single polynucleotide strand having both a sense and antisense region; in some preferred embodiments the polynucleotide strand has a hairpin structure.

In certain embodiments, the nucleic acid molecule (e.g., siNA molecule) is a double stranded nucleic acid (dsNA) molecule that is symmetrical with regard to overhangs, and has a blunt end on both ends. In other embodiments the nucleic acid molecule (e.g., siNA molecule) is a dsNA molecule that is symmetrical with regard to overhangs, and has an overhang on both ends of the dsNA molecule; preferably the molecule has overhangs of 1, 2, 3, 4, 5, 6, 7, or 8 nucleotides; preferably the molecule has 2 nucleotide overhangs. In some embodiments the overhangs are 5' overhangs; in alternative embodiments the overhangs are 3' overhangs. In certain embodiments, the overhang nucleotides are modified with modifications as disclosed herein. In some embodiments the overhang nucleotides are 2'-deoxynucleotides.

In certain preferred embodiments, the nucleic acid molecule (e.g., siNA molecule) is a dsNA molecule that is asymmetrical with regard to overhangs, and has a blunt end on one end of the molecule and an overhang on the other end of the molecule. In certain embodiments the overhang is 1, 2, 3, 4, 5, 6, 7, or 8 nucleotides; preferably the overhang is 2 nucleotides. In some preferred embodiments an asymmetrical dsNA molecule has a 3'-overhang (for example a two nucleotide 3'-overhang) on one side of a duplex occurring on the sense strand; and a blunt end on the other side of the molecule. In some preferred embodiments an asymmetrical dsNA molecule has a 5'-overhang (for example a two nucleotide 5'-overhang) on one side of a duplex occurring on the sense strand; and a blunt end on the other side of the molecule. In other preferred embodiments an asymmetrical dsNA molecule has a 3'-overhang (for example a two nucleotide 3'-overhang) on one side of a duplex occurring on the antisense strand; and a blunt end on the other side of the molecule. In some preferred embodiments an asymmetrical dsNA molecule has a 5'-overhang (for example a two nucleotide 5'-overhang) on one side of a duplex occurring on the antisense strand; and a blunt end on the other side of the molecule. In certain preferred embodiments, the overhangs are 2'-deoxynucleotides.

In some embodiments, the nucleic acid molecule (e.g., siNA molecule) has a hairpin structure (having the sense strand and antisense strand on one polynucleotide), with a loop structure on one end and a blunt end on the other end. In some embodiments, the nucleic acid molecule has a hairpin structure, with a loop structure on one end and an overhang end on the other end (for example a 1, 2, 3, 4, 5, 6, 7, or 8 nucleotide overhang); in certain embodiments, the overhang is a 3'-overhang; in certain embodiments the overhang is a 5'-overhang; in certain embodiments the overhang is on the sense strand; in certain embodiments the overhang is on the antisense strand.

In some preferred embodiments, the nucleic acid molecule is selected from the nucleic acid molecules shown on Table I.

The nucleic acid molecules (e.g., siNA molecule) disclosed herein may include one or more modifications or modified nucleotides such as described herein. For example, a nucleic acid molecule (e.g., siNA molecule) as provided herein may include a modified nucleotide having a modified sugar; a modified nucleotide having a modified nucleobase; or a modified nucleotide having a modified phosphate group. Similarly, a nucleic acid molecule (e.g., siNA molecule) as provided herein may include a modified phosphodiester backbone and/or may include a modified terminal phosphate group.

Nucleic acid molecules (e.g., siNA molecules) as provided may have one or more nucleotides that include a modified sugar moiety, for example as described herein. In some preferred embodiments the modified sugar moiety is selected from the group consisting of 2'-O-methyl, 2'-methoxyethoxy, 2'-deoxy, 2'-fluoro, 2'-allyl, 2'-O-[2-(methylamino)-2-oxoethyl], 4'-thio, 4'-$(CH_2)_2$—O-2'-bridge, 2'-locked nucleic acid, and 2'-O—(N-methylcarbamate).

Nucleic acid molecules (e.g., siNA molecules) as provided may have one or more modified nucleobase(s) for example as described herein, which preferably may be one selected from the group consisting of xanthine, hypoxanthine, 2-aminoadenine, 6-methyl and other alkyl derivatives of adenine and guanine, 2-propyl and other alkyl derivatives of adenine and guanine, 5-halouracil and cytosine, 5-propynyl uracil and cytosine, 6-azo uracil, cytosine and thymine, 5-uracil (pseudouracil), 4-thiouracil, 8-halo, amino, thiol, thioalkyl, hydroxyl and other 8-substituted adenines and guanines, 5-trifluoromethyl and other 5-substituted uracils and cytosines, 7-methyl guanine, and acyclonucleotides.

Nucleic acid molecules (e.g., siNA molecules) as provided may have one or more modifications to the phosphodiester backbone, for example as described herein. In some preferred embodiments the phosphodiester bond is modified by substituting the phosphodiester bond with a phosphorothioate, 3'- (or -5')deoxy-3'-(or -5')thio-phosphorothioate, phosphorodithioate, phosphoroselenates, 3'-(or -5')deoxy phosphinates, borano phosphates, 3'-(or -5')deoxy-3'-(or 5'-) amino phosphoramidates, hydrogen phosphonates, borano phosphate esters, phosphoramidates, alkyl or aryl phosphonates and phosphotriester or phosphorus linkages.

In various embodiments, the provided nucleic acid molecules (e.g., siNA molecules) may include one or modifications in the sense strand but not the antisense strand. In some embodiments the provided nucleic acid molecules (e.g., siNA molecules) include one or more modifications in the antisense strand but not the sense strand. In some embodiments the provided nucleic acid molecules (e.g., siNA molecules) include one or more modifications in the both the sense strand and the antisense strand.

In some embodiments in which the provided nucleic acid molecules (e.g., siNA molecules) have modifications, the sense strand includes a pattern of alternating modified and unmodified nucleotides, and/or the antisense strand includes a pattern of alternating modified and unmodified nucleotides; in some preferred versions of such embodiments the modification is a 2'-O-methyl (2' methoxy or 2'OMe) sugar moiety. The pattern of alternating modified and unmodified nucleotides may start with a modified nucleotide at the 5' end or 3' end of one of the strands; for example the pattern of alternating modified and unmodified nucleotides may start with a modified nucleotide at the 5' end or 3' end of the sense strand and/or the pattern of alternating modified and unmodified nucleotides may start with a modified nucleotide at the 5' end or 3' end of the antisense strand. When both the antisense and sense strand include a pattern of alternating modified nucleotides, the pattern of modified nucleotides may be configured such that modified nucleotides in the sense strand are opposite modified nucleotides in the antisense strand; or there may be a phase shift in the pattern such that modified nucleotides of the sense strand are opposite unmodified nucleotides in the antisense strand and vice-versa.

The nucleic acid molecules (e.g., siNA molecules) as provided herein may include 1-3 (i.e., 1, 2 or 3) deoxynucleotides at the 3' end of the sense and/or antisense strand.

The nucleic acid molecules (e.g., siNA molecules) as provided herein may include a phosphate group at the 5' end of the sense and/or antisense strand.

In one aspect, provided are double stranded nucleic acid molecules having the structure (A1):

(A1) 5' (N)x-Z 3' (antisense strand)
3' Z'—(N')y-z" 5' (sense strand)

wherein each of N and N' is a nucleotide which may be unmodified or modified, or an unconventional moiety;

wherein each of (N)x and (N')y is an oligonucleotide in which each consecutive N or N' is joined to the next N or N' by a covalent bond;

wherein each of Z and Z' is independently present or absent, but if present independently includes 1-5 consecutive nucleotides or non-nucleotide moieties or a combination thereof covalently attached at the 3' terminus of the strand in which it is present;

wherein z" may be present or absent, but if present is a capping moiety covalently attached at the 5' terminus of (N')y;

wherein each of x and y is independently an integer between 18 and 40;

wherein the sequence of (N')y has complementary to the sequence of (N)x; and wherein (N)x includes an antisense sequence to SEQ ID NO:1. In some embodiments (N)x includes an antisense oligonucleotide present in Table A-19. In other embodiments (N)x is selected from an antisense oligonucleotide present in Tables B or C.

In some embodiments the covalent bond joining each consecutive N or N' is a phosphodiester bond.

In some embodiments x=y and each of x and y is 19, 20, 21, 22 or 23. In various embodiments x=y=19.

In some embodiments of nucleic acid molecules (e.g., siNA molecules) as disclosed herein, the double stranded nucleic acid molecule is a siRNA, siNA or a miRNA.

In some embodiments, the antisense and sense strands are selected from the sequence pairs set forth in SERPINH1_4 (SEQ ID NOS:195 and 220), SERPINH1_12 (SEQ ID NOS:196 and 221), SERPINH1_30 (SEQ ID NOS:199 and 224), and SERPINH1_58 (SEQ ID NOS:208 and 233), In some embodiments the antisense and sense strands are the sequence pairs set forth in SERPINH1_4 (SEQ ID NOS:195 and 220). In some embodiments the antisense and sense strands are the sequence pairs set forth in SERPINH1_12 (SEQ ID NOS:196 and 221). In some embodiments the antisense and sense strands are the sequence pairs set forth in SERPINH1_30 (SEQ ID NOS:199 and 224), In some embodiments the antisense and sense strands are the sequence pairs set forth in SERPINH1_58 (SEQ ID NOS:208 and 233).

In some embodiments the double stranded nucleic acid molecules comprise a DNA moiety or a mismatch to the target at position 1 of the antisense strand (5' terminus). Such a structure is described herein. According to one embodiment provided are modified nucleic acid molecules having a structure (A2) set forth below:

(A2) 5' $N^1$—(N)x-Z 3' (antisense strand)
3' Z'—$N^2$—(N')y-z" 5' (sense strand)

wherein each of $N^2$, N and N' is an unmodified or modified ribonucleotide, or an unconventional moiety;

wherein each of (N)x and (N')y is an oligonucleotide in which each consecutive N or N' is joined to the adjacent N or N' by a covalent bond;

wherein each of x and y is independently an integer between 17 and 39;

wherein the sequence of (N')y has complementarity to the sequence of (N)x and (N)x has complementarity to a consecutive sequence in a target RNA;

wherein $N^1$ is covalently bound to (N)x and is mismatched to the target RNA or is a complementary DNA moiety to the target RNA;

wherein $N^1$ is a moiety selected from the group consisting of natural or modified uridine, deoxyribouridine, ribothymidine, deoxyribothymidine, adenosine or deoxyadenosine;

wherein z" may be present or absent, but if present is a capping moiety covalently attached at the 5' terminus of $N^2$—(N')y; and wherein each of Z and Z' is independently present or absent, but if present is independently 1-5 consecutive nucleotides, consecutive non-nucleotide moieties or a combination thereof covalently attached at the 3' terminus of the strand in which it is present.

In some embodiments the sequence of (N')y is fully complementary to the sequence of (N)x. In various embodiments sequence of $N^2$—(N')y is complementary to the sequence of $N^1$—(N)x. In some embodiments (N)x comprises an antisense that is fully complementary to about 17 to about 39 consecutive nucleotides in a target RNA. In other embodiments (N)x comprises an antisense that is substantially complementary to about 17 to about 39 consecutive nucleotides in a target RNA.

In some embodiments $N^1$ and $N^2$ form a Watson-Crick base pair, In some embodiments $N^1$ and $N^2$ form a non-Watson-Crick base pair. In some embodiments a base pair is formed between a ribonucleotide and a deoxyribonucleotide.

In some embodiments x=y=18, x=y=19 or x=y=20. In preferred embodiments x=y=18. When x=18 in $N^1$—(N)x, $N^1$ refers to position 1 and positions 2-19 are included in $(N)_{18}$. When y=18 in $N^2$—(N')y, $N^2$ refers to position 19 and positions 1-18 are included in $(N')_{18}$.

In some embodiments $N^1$ is covalently bound to (N)x and is mismatched to the target RNA. In various embodiments $N^1$ is covalently bound to (N)x and is a DNA moiety complementary to the target RNA.

In some embodiments a uridine in position 1 of the antisense strand is substituted with an $N^1$ selected from adenosine, deoxyadenosine, deoxyuridine (dU), ribothymidine or deoxythymidine. In various embodiments $N^1$ selected from adenosine, deoxyadenosine or deoxyuridine.

In some embodiments guanosine in position 1 of the antisense strand is substituted with an $N^1$ selected from adenosine, deoxyadenosine, uridine, deoxyuridine, ribothymidine or deoxythymidine. In various embodiments $N^1$ is selected from adenosine, deoxyadenosine, uridine or deoxyuridine.

In some embodiments cytidine in position 1 of the antisense strand is substituted with an $N^1$ selected from adenosine, deoxyadenosine, uridine, deoxyuridine, ribothymidine or deoxythymidine. In various embodiments $N^1$ is selected from adenosine, deoxyadenosine, uridine or deoxyuridine.

In some embodiments adenosine in position 1 of the antisense strand is substituted with an $N^1$ selected from deoxyadenosine, deoxyuridine, ribothymidine or deoxythymidine. In various embodiments $N^1$ selected from deoxyadenosine or deoxyuridine.

In some embodiments $N^1$ and $N^2$ form a base pair between uridine or deoxyuridine, and adenosine or deoxyadenosine. In other embodiments $N^1$ and $N^2$ form a base pair between deoxyuridine and adenosine.

In some embodiments the double stranded nucleic acid molecule is a siRNA, siNA or a miRNA. The double stranded nucleic acid molecules as provided herein are also referred to as "duplexes".

In some embodiments (N)x includes and antisense oligonucleotide present in Table A-18. In some embodiments x=y=18 and N1-(N)x includes an antisense oligonucleotide present in Table A-18. In some embodiments x=y=19 or x=y=20. In certain preferred embodiments x=y=−18. In some embodiments x=y=18 and the sequences of N1-(N)x and N2-(N')y are selected from the pair of oligonucleotides set forth in Table A-18. In some embodiments x=y=18 and the sequences of N1-(N)x and N2-(N')y are selected from the pair of oligonucleotides set forth in Tables D and E. In some embodiments the antisense and sense strands are selected from the sequence pairs set forth in SERPINH1_2 (SEQ ID NOS: 60 and 127), SERPINH1_6 (SEQ ID NOS: 63 and 130), SERPINH1_11 (SEQ ID NOS: 68 and 135), SERPINH1_13 (SEQ ID NOS: 69 and 136), SERPINH1_45 (SEQ ID NOS: 97 and 164), SERPINH1_45a (SEQ ID NOS: 98 and 165), SERPINH1_51 (SEQ ID NOS: 101 and 168), SERPINH1_51a (SEQ ID NOS: 105 and 172), SERPINH1_52 (SEQ ID NOS:102 and 169) or SERPINH1_86 (SEQ ID NOS: 123 and 190). In some preferred embodiments the antisense and sense strands are selected from the sequence pairs set forth in SERPINH1_2 (SEQ ID NOS: 60 and 127), SERPINH1_6 (SEQ ID NOS: 63 and 130), SERPINH1_45a (SEQ ID NOS: 98 and 165), SERPINH1_51 (SEQ ID NOS: 101 and 168) and SERPINH1_51a (SEQ ID NOS: 105 and 172).

In some preferred embodiments the antisense and sense strands are selected from the sequence pairs set forth in SERPINH1_2 (SEQ ID NOS: 60 and 127). In some embodiments the antisense and sense strands are the sequence pairs set forth in SERPINH1_6 (SEQ ID NOS: 63 and 130). In some embodiments the antisense and sense strands are the sequence pairs set forth in SERPINH1_11 (SEQ ID NOS: 68 and 135). In some embodiments the antisense and sense strands are the sequence pairs set forth in SERPINH1_13 (SEQ ID NOS: 69 and 136). In some embodiments the antisense and sense strands are the sequence pairs set forth in SERPINH1_45 (SEQ ID NOS: 97 and 164). In some embodiments the antisense and sense strands are the sequence pairs set forth in SERPINH1_45a (SEQ ID NOS: 98 and 165). In some embodiments the antisense and sense strands are the sequence pairs set forth in SERPINH1_51 (SEQ ID NOS: 101 and 168). In some embodiments the antisense and sense strands are the sequence pairs set forth in SERPINH1_51a (SEQ ID NOS: 105 and 172). In some embodiments the antisense and sense strands are the sequence pairs set forth in SERPINH1_52 (SEQ ID NOS: 102 and 169). In some embodiments the antisense and sense strands are the sequence pairs set forth in (SEQ ID NOS: 123 and 190). In some preferred embodiments the antisense and sense strands are selected from the sequence pairs set forth in SERPINH1_2 (SEQ ID NOS: 60 and 127), SERPINH1_6 (SEQ ID NOS: 63 and 130), SERPINH1_45a (SEQ ID NOS: 98 and 165), SERPINH1_51 (SEQ ID NOS: 101 and 168) and SERPINH1_51a (SEQ ID NOS: 105 and 172).

In some embodiments N1 and N2 form a Watson-Crick base pair. In other embodiments N1 and N2 form a non-Watson-Crick base pair. In some embodiments N1 is a modified riboadenosine or a modified ribouridine.

In some embodiments N1 and N2 form a Watson-Crick base pair. In other embodiments N1 and N2 form a non-Watson-Crick base pair. In certain embodiments N1 is selected from the group consisting of riboadenosine, modified riboadenosine, deoxyriboadenosine, modified deoxyriboadenosine. In other embodiments N1 is selected from the group consisting of ribouridine, deoxyribouridine, modified ribouridine, and modified deoxyribouridine, In certain embodiments position 1 in the antisense strand (5' terminus) includes deoxyribouridine (dU) or adenosine. In some embodiments N1 is selected from the group consisting of riboadenosine, modified riboadenosine, deoxyriboadenosine, modified deoxyriboadenosine and N2 is selected from the group consisting of ribouridine, deoxyribouridine, modified ribouridine, and modified deoxyribouridine. In certain embodiments N1 is selected from the group consisting of riboadenosine and modified riboadenosine and N2 is selected from the group consisting of ribouridine and modified ribouridine.

In certain embodiments N1 is selected from the group consisting of ribouridine, deoxyribouridine, modified ribouridine, and modified deoxyribouridine and N2 is selected from the group consisting of riboadenosine, modified riboadenosine, deoxyriboadenosine, modified deoxyriboadenosine. In certain embodiments N1 is selected from the group consisting of ribouridine and deoxyribouridine and N2 is selected from the group consisting of riboadenosine and modified riboadenosine. In certain embodiments N1 is ribouridine and N2 is riboadenosine. In certain embodiments N1 is deoxyribouridine and N2 is riboadenosine.

In some embodiments of Structure (A2), N1 includes 2'OMe sugar-modified ribouracil or 2'OMe sugar-modified riboadenosine. In certain embodiments of structure (A), N2 includes a 2'OMe sugar modified ribonucleotide or deoxyribonucleotide.

In some embodiments of Structure (A2), N1 includes 2'OMe sugar-modified ribouracil or 2'OMe sugar-modified ribocytosine. In certain embodiments of structure (A), N2 includes a 2'OMe sugar modified ribonucleotide.

In some embodiments each of N and N' is an unmodified nucleotide. In some embodiments at least one of N or N' includes a chemically modified nucleotide or an unconventional moiety. In some embodiments the unconventional moiety is selected from a mirror nucleotide, an abasic ribose moiety and an abasic deoxyribose moiety. In some embodiments the unconventional moiety is a mirror nucleotide, preferably an L-DNA moiety. In some embodiments at least one of N or N' includes a 2'OMe sugar-modified ribonucleotide.

In some embodiments the sequence of (N')y is fully complementary to the sequence of (N)x. In other embodiments the sequence of (N')y is substantially complementary to the sequence of (N)x.

In some embodiments (N)x includes an antisense sequence that is fully complementary to about 17 to about 39 consecutive nucleotides in a target mRNA. In other embodiments (N)x includes an antisense that is substantially complementary to about 17 to about 39 consecutive nucleotides in a target mRNA.

In some embodiments of Structure A1 and Structure A2 the compound is blunt ended, for example wherein both Z and Z' are absent. In an alternative embodiment, at least one of Z or Z' is present. Z and Z' independently include one or more covalently linked modified and or unmodified nucleotides, including deoxyribonucleotides and ribonucleotides, or an unconventional moiety for example inverted abasic deoxyribose moiety or abasic ribose moiety; a non-nucleotide C3, C4 or C5 moiety, an amino-6 moiety, a mirror nucleotide and the like. In some embodiments each of Z and Z' independently includes a C3 moiety or an amino-C6 moiety. In some embodiments Z' is absent and Z is present and includes a non-nucleotide C3 moiety. In some embodiments Z is absent and Z' is present and includes a non-nucleotide C3 moiety.

In some embodiments of Structure A1 and Structure A2, each N consists of an unmodified ribonucleotide. In some embodiments of Structure A1 and Structure A2, each N' consists of an unmodified nucleotide. In preferred embodiments, at least one of N and N' is a modified ribonucleotide or an unconventional moiety.

In other embodiments the compound of Structure A1 or Structure A2 includes at least one ribonucleotide modified in the sugar residue. In some embodiments the compound includes a modification at the 2' position of the sugar residue. In some embodiments the modification in the 2' position includes the presence of an amino, a fluoro, an alkoxy or an alkyl moiety. In certain embodiments the 2' modification includes an alkoxy moiety. In preferred embodiments the alkoxy moiety is a methoxy moiety (also known as 2'-O-methyl; 2'OMe; 2'-OCH3). In some embodiments the nucleic acid compound includes 2'OMe sugar modified alternating ribonucleotides in one or both of the antisense and the sense strands. In other embodiments the compound includes 2'OMe sugar modified ribonucleotides in the antisense strand, (N)x or N1-(N)x, only. In certain embodiments the middle ribonucleotide of the antisense strand; e.g. ribonucleotide in position 10 in a 19-mer strand is unmodified. In various embodiments the nucleic acid compound includes at least 5 alternating 2'OMe sugar modified and unmodified ribonucleotides. In additional embodiments the compound of Structure A1 or Structure A2 includes modified ribonucleotides in alternating positions wherein each ribonucleotide at the 5' and 3' termini of (N)x or N1-(N)x are modified in their sugar residues, and each ribonucleotide at the 5' and 3' termini of (N')y or N2-(N)y are unmodified in their sugar residues.

In some embodiments the double stranded molecule includes one or more of the following modifications
a) N in at least one of positions 5, 6, 7, 8, or 9 from the 5' terminus of the antisense strand is selected from a 2'5' nucleotide or a mirror nucleotide;
b) N' in at least one of positions 9 or 10 from the 5' terminus of the sense strand is selected from a 2'5' nucleotide and a pseudoUridine; and
c) N' in 4, 5, or 6 consecutive positions at the 3' terminus positions of (N')y comprises a 2'5' nucleotide.

In some embodiments the double stranded molecule includes a combination of the following modifications
a) the antisense strand includes a 2'5' nucleotide or a mirror nucleotide in at least one of positions 5, 6, 7, 8, or 9 from the 5' terminus; and
b) the sense strand includes at least one of a 2'5' nucleotide and a pseudoUridine in positions 9 or 10 from the 5' terminus.

In some embodiments the double stranded molecule includes a combination of the following modifications
a) the antisense strand includes a 2'5' nucleotide or a mirror nucleotide in at least one of positions 5, 6, 7, 8, or 9 from the 5' terminus; and
c) the sense strand includes 4, 5, or 6 consecutive 2'5' nucleotides at the 3' penultimate or 3' terminal positions.

In some embodiments, the sense strand [(N)x or N1-(N)x] includes 1, 2, 3, 4, 5, 6, 7, 8, or 9 2'OMe sugar modified ribonucleotides. In some embodiments, the antisense strand includes 2'OMe modified ribonucleotides at positions 2, 4, 6, 8, 11, 13, 15, 17 and 19. In other embodiments antisense strand includes 2'OMe modified ribonucleotides at positions 1, 3, 5, 7, 9, 11, 13, 15, 17 and 19. In other embodiments the antisense strand includes 2'OMe modified ribonucleotides at positions 3, 5, 7, 9, 11, 13, 15, 17 and 19. In some embodiments the antisense strand includes one or more 2'OMe sugar modified pyrimidines. In some embodiments all the pyrimidine nucleotides in the antisense strand are 2'OMe sugar modified. In some embodiments the sense strand includes 2'OMe sugar modified pyrimidines.

In some embodiments of Structure A1 and Structure A2, neither the sense strand nor the antisense strand is phosphorylated at the 3' and 5' termini. In other embodiments one or both of the sense strand or the antisense strand are phosphorylated at the 3' termini.

In some embodiments of Structure A1 and Structure A2 (N)y includes at least one unconventional moiety selected from a mirror nucleotide, a 2'5' nucleotide and a TNA. In some embodiments the unconventional moiety is a mirror nucleotide. In various embodiments the mirror nucleotide is selected from an L-ribonucleotide (L-RNA) and an L-deoxyribonucleotide (L-DNA). In preferred embodiments the mirror nucleotide is L-DNA. In certain embodiments the sense strand comprises an unconventional moiety in position 9 or 10 (from the 5' terminus). In preferred embodiments the sense strand includes an unconventional moiety in position 9 (from the 5' terminus). In some embodiments the sense strand is 19 nucleotides in length and comprises 4, 5, or 6 consecutive unconventional moieties in positions 15, (from the 5' terminus). In some embodiments the sense strand includes 4 consecutive 2'5' ribonucleotides in positions 15, 16, 17, and 18. In some embodiments the sense strand includes 5 consecutive 2'5' ribonucleotides in positions 15, 16, 17, 18 and 19. In various embodiments the sense strand further comprises Z'. In some embodiments Z' includes a C3OH moiety or a C3Pi moiety.

In some embodiments of Structure A1 (N')y includes at least one L-DNA moiety. In some embodiments x=y=19 and (N')y, consists of unmodified ribonucleotides at positions 1-17 and 19 and one L-DNA at the 3' penultimate position (position 18). In other embodiments x=y=19 and (N')y consists of unmodified ribonucleotides at positions 1-16 and 19 and two consecutive L-DNA at the 3' penultimate position (positions 17 and 18). In various embodiments the unconventional moiety is a nucleotide joined to an adjacent nucleotide by a 2'-5' internucleotide phosphate linkage. According to various embodiments (N')y includes 2, 3, 4, 5, or 6 consecutive ribonucleotides at the 3' terminus linked by 2'-5' internucleotide linkages. In one embodiment, four consecutive nucleotides at the 3' terminus of (N')y are joined by three 2'-5' phosphodiester bonds, wherein one or more of the 2'-5' nucleotides which form the 2'-5' phosphodiester bonds further includes a 3'-O-methyl (3'OMe) sugar modification. Preferably the 3' terminal nucleotide of (N')y includes a 2'OMe sugar modification. In certain embodiments x=y=19 and (N')y includes two or more consecutive nucleotides at positions 15, 16, 17, 18 and 19 include a nucleotide joined to an adjacent nucleotide by a 2'-5' internucleotide bond (2'-5' nucleotide). In various embodiments the nucleotide forming the 2'-5' internucleotide bond includes a 3' deoxyribose nucleotide or a 3' methoxy nucleotide (3' H or 3'OMe in place of a 3' OH). In some embodiments x=y=19 and (N')y includes 2'-5' nucleotides at positions 15, 16 and 17 such that adjacent nucleotides are linked by a 2'-5' internucleotide bond between positions 15-16, 16-17 and 17-18; or at positions, 15, 16, 17, 18, and 19 such that adjacent nucleotides are linked by a 2'-5' internucleotide bond between positions 15-16, 16-17, 17-18 and 18-19 and a 3'OH is available at the 3' terminal nucleotide or at positions 16, 17 and 18 such that adjacent nucleotides are linked by a 2'-5' internucleotide bond between positions 16-17, 17-18 and 18-19. In some embodiments x=y=19 and (N')y includes 2'-5' nucleotides at positions 16 and 17 or at positions 17 and 18 or at positions 15 and 17 such that adjacent nucleotides are linked by a 2'-5' internucleotide bond between positions 16-17 and 17-18 or between positions 17-18 and 18-19 or between positions 15-16 and 17-18, respectively. In other embodiments the pyrimidine ribonucleotides (rU, rC) in (N')y are substituted with nucleotides joined to the adjacent nucleotide by a 2'-5' internucleotide bond. In some embodiments the antisense and sense strands are selected from the sequence pairs set forth in SERPINH1_4, SERPINH1_12, SERPINH1_18, SERPINH1_30, SERPINH1_58 or SERPINH1_88, and x=y=19 and (N')y comprises five consecutive nucleotides at the 3' terminus joined by four 2'-5' linkages, specifically the linkages between the nucleotides position 15-16, 16-17, 17-18 and 18-19.

In some embodiments the linkages include phosphodiester bonds. In some embodiments the antisense and sense strands are selected from the sequence pairs set forth in SERPINH1_4, SERPINH1_12, SERPINH1_18, SERPINH1_30, SERPINH1_58 or SERPINH1_88 and x=y=19 and (N')y comprises five consecutive nucleotides at the 3' terminus joined by four 2'-5' linkages and optionally further includes Z' and z' independently selected from an inverted abasic moiety and a C3 alkyl [C3; 1,3-propanediol mono(dihydrogen phosphate)] cap. The C3 alkyl cap is covalently linked to the 3' or 5' terminal nucleotide. In some embodiments the 3' C3 terminal cap further comprises a 3' phosphate. In some embodiments the 3' C3 terminal cap further comprises a 3' terminal hydroxy group.

In some embodiments the antisense and sense strands are selected from the sequence pairs set forth in SERPINH1_4, SERPINH1_12, SERPINH1_18, SERPINH1_30, SERPINH1_58 or SERPINH1_88 and x=y=19 and (N')y includes an L-DNA position 18; and (N')y optionally further includes Z' and z' independently selected from an inverted abasic moiety and a C3 alkyl [C3; 1,3-propanediol mono (dihydrogen phosphate)] cap.

In some embodiments (N')y includes a 3' terminal phosphate. In some embodiments (N')y includes a 3' terminal hydroxyl.

In some embodiments the antisense and sense strands are selected from the sequence pairs set forth in SERPINH1_4, SERPINH1_12, SERPINH1_18, SERPINH1_30, SERPINH1_58 or SERPINH1_88 and x=y=19 and (N)x includes 2'OMe sugar modified ribonucleotides at positions 1, 3, 5, 7, 9, 11, 13, 15, 17, 19 or at positions 2, 4, 6, 8, 11, 13, 15, 17, 19. In some embodiments the antisense and sense strands are selected from the sequence pairs set forth in SERPINH1_4, SERPINH1_12, SERPINH1_18, SERPINH1_30, SERPINH1_58 and SERPINH1_88 and x=y=19 and (N)x includes 2'OMe sugar modified pyrimidines. In some embodiments all pyrimidines in (N)x include the 2'OMe sugar modification.

In some embodiments the antisense and sense strands are selected from the sequence pairs set forth in SERPINH1_2, SERPINH1_6, SERPINH1_11, SERPINH1_13, SERPINH1_45, SERPINH1_45a, SERPINH1_51, SERPINH51a, SERPINH1_52 or SERPINH1_86 and x=y=18 and N2 is a riboadenosine moiety.

In some embodiments the antisense and sense strands are selected from the sequence pairs set forth in SERPINH1_2, SERPINH1_6, SERPINH1_11, SERPINH1_13, SERPINH1_45. SERPINH1_45a, SERPINH1_51. SERPINH51a, SERPINH1_52 or SERPINH1_86 and x=y=18, and N2-(N')y includes five consecutive nucleotides at the 3' terminus joined by four 2'-5' linkages, specifically the linkages between the nucleotides position 15-16, 16-17, 17-18 and 18-19. In some embodiments the linkages include phosphodiester bonds.

In some embodiments the antisense and sense strands are selected from the sequence pairs set forth in SERPINH1_2, SERPINH1_6, SERPINH1_11, SERPINH1_13, SERPINH1_45, SERPINH1_45a, SERPINH1_51, SERPINH1_51a, SERPINH1_52 or SERPINH1_86 and x=y=18 and N2-(N')y includes five consecutive nucleotides at the 3' terminus joined by four 2'-5' linkages and optionally further includes Z' and z' independently selected from an inverted abasic moiety and a C3 alkyl [C3; 1,3-propanediol mono(dihydrogen phosphate)] cap.

In some embodiments the antisense and sense strands are selected from the sequence pairs set forth in SERPINH1_2, SERPINH1_6, SERPINH1_11, SERPINH1_13, SERPINH1_45, SERPINH1_45a, SERPINH1_51, SERPINH1_51a, SERPINH1_52 or SERPINH1_86 and x=y=18 and $N^2$—(N')y includes an L-DNA position 18; and (N')y optionally further includes Z' and z' independently selected from an inverted abasic moiety and a C3 alkyl [C3; 1,3-propanediol mono(dihydrogen phosphate)] cap.

In some embodiments $N^2$—(N')y comprises a 3' terminal phosphate. In some embodiments N2-(N')y comprises a 3' terminal hydroxyl.

In some embodiments the antisense and sense strands are selected from the sequence pairs set forth in SERPINH1_2, SERPINH1_6, SERPINH1_11, SERPINH1_13, SERPINH1_45, SERPINH1_45a, SERPINH1_51, SERPINH1_51a, SERPINH1_52 or SERPINH1_86 and x=y=18 and $N^1$—(N)x includes 2'OMe sugar modified ribonucleotides in positions 1, 3, 5, 7, 9, 11, 13, 15, 17, 19 or in positions 1, 3, 5, 9, 11, 13, 15, 17, 19, or in positions 3, 5, 9, 11, 13, 15, 17, or in positions 2, 4, 6, 8, 11, 13, 15, 17, 19. In some embodiments the antisense and sense strands are selected from the sequence pairs set forth in SERPINH1_2, SERPINH1_6, SERPINH1_11, SERPINH1_13, SERPINH1_45, SERPINH1_45a, SERPINH1_51, SERPINH1_52 or SERPINH1_86 and x=y=18 and $N^1$—(N)x includes 2'OMe sugar modified ribonucleotides at positions 11, 13, 15, 17 and 19 (from 5' terminus). In some embodiments the antisense and sense strands are selected from the sequence pairs set forth in SERPINH1_2, SERPINH1_6, SERPINH1_11, SERPINH1_13, SERPINH1-45. SERPINH1_45a, SERPINH1_51, SERPINH1_51a, SERPINH1_52 or SERPINH1_86 and x=y=18 and $N^1$—(N)x includes 2'OMe sugar modified ribonucleotides in positions 1, 3, 5, 7, 9, 11, 13, 15, 17, 19 or in positions 3, 5, 7, 9, 11, 13, 15, 17, 19. In some embodiments the antisense and sense strands are selected from the sequence pairs set forth in SERPINH1_2, SERPINH1_6, SERPINH1_11, SERPINH1_13, SERPINH1_45, SERPINH1_45a, SERPINH1_51, SERPINH1_52 or SERPINH1_86 and x=y=18 and N1-(N)x includes 2'OMe sugar modified ribonucleotides in positions 2, 4, 6, 8, 11, 13, 15, 17, 19.

In some embodiments the antisense and sense strands are selected from the sequence pairs set forth in SERPINH1_2, SERPINH1_6, SERPINH1_11, SERPINH1_13, SERPINH1_45, SERPINH1_45a, SERPINH1_51, SERPINH1_51a, SERPINH1_52 or SERPINH1_86 and x=y=18 and N1-(N)x includes 2'OMe sugar modified pyrimidines. In some embodiments all pyrimidines in (N)x include the 2'OMe sugar modification. In some embodiments the antisense strand further includes an L-DNA or a 2'-5' nucleotide in position 5, 6 or 7 (5'>3'). In other embodiments the antisense strand further includes a ribonucleotide which generates a 2'5' internucleotide linkage in between the ribonucleotides in positions 5-6 or 6-7 (5'>3')

In additional embodiments N1-(N)x further includes Z wherein Z includes a non-nucleotide overhang. In some embodiments the non-nucleotide overhang is C3-C3 [1,3-propanediol mono(dihydrogen phosphate)]2.

In some embodiments of Structure A2, (N)y includes at least one L-DNA moiety. In some embodiments x=y=18 and (N')y consists of unmodified ribonucleotides at positions 1-16 and 18 and one L-DNA at the 3' penultimate position (position 17). In other embodiments x=y=18 and (N')y consists of unmodified ribonucleotides at position 1-15 and 18 and two consecutive L-DNA at the 3' penultimate position (positions 16 and 17). In various embodiments the unconventional moiety is a nucleotide joined to an adjacent nucleotide by a 2'-5' internucleotide phosphate linkage. According to various embodiments (N')y includes 2, 3, 4, 5, or 6 consecutive ribonucleotides at the 3' terminus linked by 2'-5' internucleotide linkages. In one embodiment, four consecutive nucleotides at the 3' terminus of (N')y are joined by three 2'-5' phosphodiester bonds, wherein one or more of the 2'-5' nucleotides which form the 2'-5' phosphodiester bonds further includes a 3'-O-methyl (3'OMe) sugar modification. Preferably the 3' terminal nucleotide of (N')y includes a 2'OMe sugar modification. In certain embodiments x=y=18 and in (N')y two or more consecutive nucleotides at positions 14, 15, 16, 17, and 18 include a nucleotide joined to an adjacent nucleotide by a 2'-5' internucleotide bond. In various embodiments the nucleotide forming the 2'-5' internucleotide bond includes a 3' deoxyribose nucleotide or a 3' methoxy nucleotide. In some embodiments x=y=18 and (N')y includes nucleotides joined to the adjacent nucleotide by a 2'-5' internucleotide bond between positions 15-16, 16-17 and 17-18 or between positions 16-17 and 17-18. In some embodiments x=y=18 and (N')y includes nucleotides joined to the adjacent nucleotide by a 2'-5' internucleotide bond between positions 14-15, 15-16, 16-17, and 17-18 or between positions 15-16, 16-17, and 17-18 or between positions 16-17 and 17-18 or between positions 17-18 or between positions 15-16 and 17-18. In other embodiments the pyrimidine ribonucleotides (rU, rC) in (N')y are substituted with nucleotides joined to the adjacent nucleotide by a 2'-5' internucleotide bond.

In some embodiments the antisense and sense strands are selected from the oligonucleotide pairs set forth in Table A-18 and identified herein as SERPINH1_2 (SEQ ID NOS: 60 and 127), SERPINH1_6 (SEQ ID NOS: 63 and 130), SERPINH1_45a (SEQ ID NOS: 98 and 165), SERPINH1_51 (SEQ ID NOS: 101 and 168) and SERPINH1_51a (SEQ ID NOS: 105 and 172).

In some embodiments the double stranded nucleic acid molecule includes the antisense strand set forth in SEQ ID NO:127 and sense strand set forth in SEQ ID NO:60; identified herein as SERPINH1_2. In some embodiments the double stranded nucleic acid molecule has the structure

```
5' UAUAGCACCCAUGUGUCUC - Z 3'    (antisense
   |||||||||||||||||||           SEQ ID NO: 127)
3' Z' - AUAUCGUGGGUACACAGAG - z" 5' (sense
                                    SEQ ID NO: 60)
``` wherein each "|" represents base pairing between the ribonucleotides;
wherein each of A, C, G, U is independently an unmodified or modified ribonucleotide, or an unconventional moiety;
wherein each of Z and Z' is independently present or absent, but if present is independently 1-5 consecutive nucleotides or non-nucleotide moieties or a combination thereof covalently attached at the 3' terminus of the strand in which it is present; and
wherein z" may be present or absent, but if present is a capping moiety covalently attached at the 5' terminus of N2-(N')y.

In some embodiments provided is a double stranded nucleic acid molecule wherein the antisense strand (SEQ ID NO:127) includes one or more 2'OMe sugar modified pyrimidines and or purines, a 2'-5' ribonucleotide in position 5, 6, 7 or 8, and a 3' terminal nucleotide or non-nucleotide overhang. In some embodiments the sense strand (SEQ ID NO:60) includes 4 or 5 consecutive 2'5' nucleotides at the 3' terminal or penultimate positions, a nucleotide or non-nucleotide moiety covalently attached at the 3' terminus and a cap moiety covalently attached at the 5' terminus. In other embodiments the sense strand (SEQ ID NO:60) includes one or more 2'OMe primidine, a nucleotide or non-nucleotide moiety covalently attached at the 3' terminus and a cap moiety covalently attached at the 5' terminus.

In some embodiments provided is a double stranded nucleic acid molecule wherein the antisense strand (SEQ ID NO:127) includes 2'OMe sugar modified ribonucleotides at positions (5'>3') 1, 3, 5, 9, 11, 15, 17 and 19, a 2'-5' ribonucleotide at position 7, and a C3Pi-C3OH moiety covalently attached to the 3' terminus; and the sense strand (SEQ ID NO:60) is selected from a sense strand which includes
a) 2'-5' ribonucleotides at positions 15, 16, 17, 18 and 19, a C3OH 3' terminal non-nucleotide overhang; and an inverted abasic deoxyribonucleotide moiety covalently attached at the 5' terminus; or
b) 2'-5' ribonucleotides at positions 15, 16, 17, 18 and 19, a 3' terminal phosphate; and an inverted abasic deoxyribonucleotide moiety covalently attached at the 5' terminus; or
c) 2'OMe sugar modified ribonucleotides at positions (5'>3') 5, 7, 13, and 16; a 2'5' ribonucleotide at position 18; a C3-OH moiety covalently attached at the 3' terminus; and an inverted abasic deoxyribonucleotide moiety covalently attached at the 5' terminus; or
d) 2'OMe sugar modified ribonucleotides at positions (5'>3') 7, 13, 16 and 18; a 2'5' ribonucleotide at position 9; a C3OH moiety covalently attached at the 3' terminus; and an inverted abasic deoxyribonucleotide moiety covalently attached at the 5' terminus; or
e) 2'-5' ribonucleotides at positions 15, 16, 17, 18, and 19: a C3-Pi moiety covalently attached at the 3' terminus; and an inverted abasic deoxyribonucleotide moiety covalently attached at the 5' terminus.

Provided herein is a double stranded nucleic acid molecule wherein the antisense strand (SEQ ID NO:127) includes 2'OMe sugar modified ribonucleotides at positions (5'>3') 1, 3, 5, 9, 11, 15, 17, 19, a 2'-5' ribonucleotide at position 7 and a C3Pi-C3OH moiety covalently attached to the 3' terminus; and the sense strand (SEQ ID NO:60) includes 2'-5' ribonucleotides at positions 15, 16, 17, 18, and 19: a C3 3' terminal overhang; and an inverted abasic deoxyribonucleotide moiety covalently attached at the 5' terminus.

Provided herein is a double stranded nucleic acid molecule wherein the antisense strand (SEQ ID NO:127) includes 2'OMe sugar modified ribonucleotides at positions (5'>3') 1, 3, 5, 9, 11, 15, 17, 19, a 2'-5' ribonucleotide at position 7 and a C3Pi-C3OH, 3' terminal overhang; and the sense strand (SEQ ID NO:60) includes 2'-5' ribonucleotides at positions 15, 16, 17, 18, and 19: a 3' terminal phosphate; and an inverted abasic deoxyribonucleotide moiety covalently attached at the 5' terminus.

Provided herein is a double stranded nucleic acid molecule wherein the antisense strand (SEQ ID NO:127) includes 2'OMe sugar modified ribonucleotides at positions (5'>3') 1, 3, 5, 9, 11, 15, 17, 19, a 2'-5' ribonucleotide at position 7 and a C3Pi-C3OH moiety covalently attached to the 3' terminus; and the sense strand (SEQ ID NO:60) includes 2'OMe sugar modified ribonucleotides at positions (5'>3') 5, 7, 13, and 16;

a 2'-5' ribonucleotide at position 18; a C3-OH moiety covalently attached at the 3' terminus; and an inverted abasic deoxyribonucleotide moiety covalently attached at the 5' terminus.

Provided herein is a double stranded nucleic acid molecule wherein the antisense strand (SEQ ID NO:127) includes 2'OMe sugar modified ribonucleotides at positions (5'>3') 1, 3, 5, 9, 11, 15, 17, 19, a 2'-5' ribonucleotide at position 7 and a C3Pi-C3OH moiety covalently attached to the 3' terminus; and the sense strand (SEQ ID NO:60) includes 2'OMe sugar modified ribonucleotides at positions (5'>3') 7, 13, 16 and 18; a 2'-5' ribonucleotide at position 9; a C3-OH moiety covalently attached at the 3' terminus; and an inverted abasic deoxyribonucleotide moiety covalently attached at the 5' terminus.

Provided herein is a double stranded nucleic acid molecule wherein the antisense strand (SEQ ID NO:127) includes 2'OMe sugar modified ribonucleotides at positions (5'>3') 1, 3, 5, 9, 11, 15, 17, 19, a 2'-5' ribonucleotide at position 7 and a C3Pi-C3OH moiety covalently attached to the 3' terminus; and the sense strand (SEQ ID NO:60) includes 2'-5' ribonucleotides at positions 15, 16, 17, 18, and 19: a C3-Pi moiety covalently attached at the 3' terminus; and an inverted abasic deoxyribonucleotide moiety covalently attached at the 5' terminus.

In some embodiments provided herein is a double stranded nucleic acid molecule wherein the antisense strand (SEQ ID NO:127) includes 2'OMe sugar modified ribonucleotides at positions (5'>3') 1, 3, 5, 9, 11, 13, 15, 17, 19 and a C3-C3 3' terminal overhang; and the sense strand (SEQ ID NO:60) includes 2'OMe sugar modified ribonucleotides at positions (5'>3') 7, 9, 13, 16 and 18; and an inverted abasic deoxyribonucleotide moiety covalently attached at the 5' terminus.

In some embodiments provided herein is a double stranded nucleic acid molecule wherein the sense strand (SEQ ID NO:60) includes 2'-5' ribonucleotides at positions 15, 16, 17, 18, and 19: a 3' terminal phosphate and an inverted abasic deoxyribonucleotide moiety covalently attached at the 5' terminus and the antisense strand (SEQ ID NO:127) includes an antisense strand selected from one of
a) 2'OMe sugar modified ribonucleotides at positions (5'>3') 1, 3, 5, 7, 9, 11, 13, 15, 17, 19 and a C3Pi-C3OH moiety covalently attached to the 3' terminus; or
b) 2'OMe sugar modified ribonucleotides at positions (5'>3') 1, 3, 6, 8, 10, 12, 14, 17, 18 and a C3Pi-C3OH moiety covalently attached to the 3' terminus.

In some embodiments provided herein is a double stranded nucleic acid molecule which includes the antisense strand set forth in SEQ ID NO:130 and the sense strand set forth in SEQ ID NO:63; identified herein as SERPINH1__6. In some embodiments the duplex comprises the structure

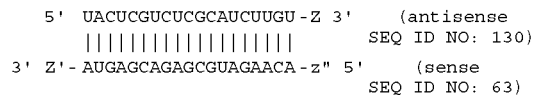

```
    5' UACUCGUCUCGCAUCUUGU-Z 3'    (antisense
       ||||||||||||||||||         SEQ ID NO: 130)
    3' Z'-AUGAGCAGAGCGUAGAACA-z" 5'  (sense
                                     SEQ ID NO: 63)
``` wherein each "|" represents base pairing between the ribonucleotides;
wherein each of A, C, G, U is independently an unmodified or modified ribonucleotide, or an unconventional moiety;
wherein each of Z and Z' is independently present or absent, but if present is independently 1-5 consecutive nucleotides or non-nucleotide moieties or a combination thereof covalently attached at the 3' terminus of the strand in which it is present; and wherein z" may be present or absent, but if present is a capping moiety covalently attached at the 5' terminus of N2-(N')y.

In some embodiments provided is a double stranded nucleic acid molecule wherein the sense strand (SEQ ID NO:63) includes one or more 2'OMe sugar modified pyrimidines; a 3' terminal nucleotide or non-nucleotide overhang; and cap moiety covalently attached at the 5' terminus. In some embodiments the antisense strand (SEQ ID NO:130) includes one or more 2'OMe sugar modified pyrimidine, a nucleotide or non-nucleotide moiety covalently attached at the 3' terminus and a cap moiety covalently attached at the 5' terminus.

In some embodiments provided is a double stranded nucleic acid molecule wherein the sense strand (SEQ ID NO:63) includes 2'OMe sugar modified ribonucleotides at positions (5'>3') 2, 14 and 18; a C3OH or C3Pi moiety covalently attached at the 3' terminus; and an inverted abasic deoxyribonucleotide moiety covalently attached at the 5' terminus; and the antisense strand (SEQ ID NO:130) is selected from an antisense strand which includes
a) 2'OMe sugar modified ribonucleotides in positions (5'>3') 1, 3, 5, 9, 11, 13, 15 and 17; a 2'-5' ribonucleotide at position 7; and a C3Pi-C3OH moiety covalently attached to the 3' terminus; or
b) 2'OMe sugar modified ribonucleotides in positions (5'>3') 1, 3, 5, 7, 9, 12, 13 and 17; a 2'-5' ribonucleotide at position 7; and a C3Pi-C3OH moiety covalently attached to the 3' terminus; or
c) 2'OMe sugar modified ribonucleotides in positions (5'>3') 3, 5, 9, 11, 13, 15 and 17; a 2'-5' ribonucleotide at position 7; and a C3Pi-C3OH moiety covalently attached to the 3' terminus; or
d) 2'OMe sugar modified ribonucleotides in positions (5'>3') 3, 5, 9, 11, 13, 15 and 17; a dU in position 1; a 2'-5' ribonucleotide in position 7; and a C3Pi-C3OH moiety covalently attached to the 3' terminus.

In some embodiments provided is a double stranded nucleic acid molecule wherein the sense strand (SEQ ID NO:63) includes 2'OMe sugar modified ribonucleotides in positions (5'>3') 2, 14 and 18; a C3-OH moiety covalently attached at the 3' terminus; and an inverted abasic deoxyribonucleotide moiety covalently attached at the 5' terminus; and the antisense strand (SEQ ID NO:130) includes 2'OMe sugar modified ribonucleotides in positions (5'>3') 1, 3, 5, 9, 11, 13, 15 and 17; a 2'-5' ribonucleotide in position 7; and a C3Pi-C3OH moiety covalently attached to the 3' terminus.

In some embodiments provided is a duplex oligonucleotide molecule wherein the sense strand (SEQ ID NO:63) includes 2'OMe sugar modified ribonucleotides in positions (5'>3') 14 and 18 and optionally in position 2; a C3-OH moiety covalently attached at the 3' terminus; and an inverted abasic deoxyribonucleotide moiety covalently attached at the 5' terminus; and the antisense strand (SEQ ID NO:130) includes 2'OMe sugar modified ribonucleotides in positions (5'>3') 1, 3, 5, 7, 9, 12, 13, and 17; a 2'-5' ribonucleotide at position 7; and a C3:Pi-C3OH moiety covalently attached to the 3' terminus.

In some embodiments provided is a duplex oligonucleotide molecule wherein the sense strand (SEQ ID NO:63) includes 2'OMe sugar modified ribonucleotides in positions (5'>3') 14 and 18; a C3-OH moiety covalently attached at the 3' terminus; and an inverted abasic deoxyribonucleotide moiety covalently attached at the 5' terminus; and the antisense strand (SEQ ID NO:130) is selected from an antisense strand which includes a) 2'OMe sugar modified ribonucleotides in positions (5'>3') 1, 3, 5, 9, 11, 13, 15 and 17; a 2'-5' ribonucleotide in position 7; and a C3Pi-C3Pi or C3Pi-C3OH moiety covalently attached to the 3' terminus; or b) 2'OMe sugar modified ribonucleotides in positions (5'>3') 1, 3, 5, 7, 9, 12, 13, and 17; a 2'-5' ribonucleotide in position 7; and a C3Pi-C3Pi or C3Pi-C3OH moiety covalently attached to the 3' terminus.

Provided herein is a double stranded nucleic acid molecule wherein the sense strand (SEQ ID NO:63) includes 2'OMe sugar modified ribonucleotides in positions (5'>3') 14 and 18; a C3-OH moiety covalently attached at the 3' terminus; and an inverted abasic deoxyribonucleotide moiety covalently attached at the 5' terminus; and the antisense strand (SEQ ID NO:130) includes 2'OMe sugar modified ribonucleotides in positions (5'>3') 1, 3, 5, 9, 11, 13, 15 and 17; a 2'-5' ribonucleotide in position 7; and a C3Pi-C3OH moiety covalently attached to the 3' terminus.

Provided herein is a double stranded nucleic acid molecule wherein the sense strand (SEQ ID NO:63) includes 2'OMe sugar modified ribonucleotides in positions (5'>3') 14 and 18; a C3-OH moiety covalently attached at the 3' terminus; and an inverted abasic deoxyribonucleotide moiety covalently attached at the 5' terminus; and the antisense strand (SEQ ID NO:130) includes 2'OMe sugar modified ribonucleotides in positions (5'>3') 1, 3, 5, 7, 9, 12, 13, and 17; a 2'-5' ribonucleotide in position 7; and a C3Pi-C3OH 3' terminal overhang.

In some embodiments the duplex includes the antisense strand set forth in SEQ ID NO:165 and sense strand set forth in SEQ ID NO:98; identified herein as SERPINH1__45a. In some embodiments the duplex comprises the structure

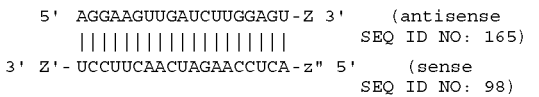

wherein each "|" represents base pairing between the ribonucleotides;
wherein each of A, C, G, U is independently an unmodified or modified ribonucleotide, or an unconventional moiety;
wherein each of Z and Z' is independently present or absent, but if present is independently 1-5 consecutive nucleotides or non-nucleotide moieties or a combination thereof covalently attached at the 3' terminus of the strand in which it is present; and
wherein z" may be present or absent, but if present is a capping moiety covalently attached at the 5' terminus of N2-(N')y.

In some embodiments the sense strand (SEQ ID NO:98) includes 2'-5' ribonucleotides in positions (5'>3') 15, 16, 17, and 18 or 15, 16, 17, 18, and 19: a nucleotide or non-nucleotide moiety covalently attached at the 3' terminus, and a cap moiety covalently attached at the 5' terminus. In some embodiments the antisense strand (SEQ ID NO:165) includes 2'OMe sugar modified pyrimidine and or purines, a 2'-5' nucleotide in position 5, 6, 7, or 8 (5'>3'); and a nucleotide or non-nucleotide moiety covalently attached at the 3' terminus.

In some embodiments the sense strand (SEQ ID NO:98) includes 2'-5' ribonucleotides in positions (5'>3') 15, 16, 17, 18, and 19: a C3Pi or C3-OH 3' terminal non-nucleotide moiety and an inverted abasic deoxyribonucleotide moiety covalently attached at the 5' terminus; and the antisense strand (SEQ ID NO:165) includes an antisense strand selected from one of a) 2'OMe sugar modified ribonucleotides in positions (5'>3') 2, 4, 6, 8, 11, 13, 15, 17, and 19; a 2'-5' ribonucleotide in position 7 and a C3Pi-C3Pi or C3Pi-C3OH 3' terminal overhang; or b) 2'OMe sugar modified ribonucleotides in positions (5'>3') 2, 4, 6, 8, 11, 13, 15, 17 and 19 and a C3Pi-C3Pi or C3Pi-C3OH 3' terminal overhang;

c) 2'OMe sugar modified ribonucleotides in positions (5'>3') 1, 3, 5, 9, 11, 13, 15, 17, and 19; a 2'-5' ribonucleotide in position 7 and a C3Pi-C3Pi or C3Pi-C3OH 3' terminal overhang; or d) 2'OMe sugar modified ribonucleotides in positions (5'>3') 1, 3, 5, 7, 9, 11, 13, 15, 17 and 19 and a C3Pi-C3Pi or C3Pi-C3OH 3' terminal overhang.

Provided herein is a double stranded nucleic acid molecule wherein the sense strand (SEQ ID NO:98) includes 2'-5' ribonucleotides in positions (5'>3') 15, 16, 17, 18, and 19: a C3-OH 3' terminal moiety and an inverted abasic deoxyribonucleotide moiety covalently attached at the 5' terminus; and the antisense strand (SEQ ID NO:165) includes 2'OMe sugar modified ribonucleotides in positions (5'>3') 2, 4, 6, 8, 11, 13, 15, 17, and 19; a 2'-5' ribonucleotide in position 7 and a C3Pi-COH 3' terminal overhang.

In some embodiments the double stranded nucleic acid molecule includes the antisense strand set forth in SEQ ID NO:168 and sense strand set forth in SEQ ID NO:101; identified herein as SERPINH1__51. In some embodiments the duplex comprises the structure

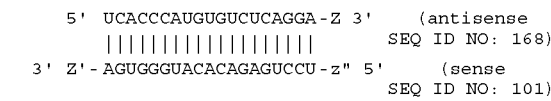

wherein each "|" represents base pairing between the ribonucleotides;
wherein each of A, C, G, U is independently an unmodified or modified ribonucleotide, or an unconventional moiety;
wherein each of Z and Z' is independently present or absent, but if present is independently 1-5 consecutive nucleotides or non-nucleotide moieties or a combination thereof covalently attached at the 3' terminus of the strand in which it is present; and
wherein z" may be present or absent, but if present is a capping moiety covalently attached at the 5' terminus of N2-(N')y.

In some embodiments provided is a double stranded nucleic acid molecule wherein the sense strand (SEQ ID NO:101) includes 2'OMe sugar modified pyrimidines, optionally a 2'-5' ribonucleotide in position 9 or 10; a nucleotide or non-nucleotide moiety covalently attached at the 3' terminus and optionally a cap moiety covalently attached at the 5' terminus. In some embodiments the antisense strand (SEQ ID NO:168) includes 2'OMe sugar modified pyrimidine and or purines, a 2'-5' nucleotide in position 5, 6, 7, or 8 (5'>3'); and a nucleotide or non-nucleotide moiety covalently attached at the 3' terminus.

In some embodiments provided is a double stranded nucleic acid molecule wherein the sense strand (SEQ ID NO:101) includes 2'OMe sugar modified pyrimidines in positions (5'>3') 4, 11, 13, and 17, optionally a 2'-5' ribonucleotide in position 9 or 10, a C3Pi or C3OH non-nucleotide moiety covalently attached at the 3' terminus and an inverted abasic deoxyribonucleotide moiety covalently attached at the 5' terminus; and the antisense strand (SEQ ID NO:168) is selected from an antisense strand which includes
a) 2'OMe sugar modified ribonucleotides in positions (5'>3') 1, 8, and 15, a 2'5' ribonucleotide in position 6 or 7; a C3Pi-C3OH overhang covalently attached at the 3' terminus; or
b) 2'OMe sugar modified ribonucleotides in positions (5'>3') 1, 4, 8, 13 and 15, a 2'5' ribonucleotide in position 6 or 7; a C3Pi-C3OH overhang covalently attached at the 3' terminus; or
c) 2'OMe sugar modified ribonucleotides in positions (5'>3') 1, 4, 8, 11 and 15, a 2'5' ribonucleotide in position 6; a C3Pi-C3OH overhang covalently attached at the 3' terminus; or
d) 2'OMe sugar modified ribonucleotides in positions (5'>3') 1, 3, 8, 12, 13, and 15; a 2'5' ribonucleotide in position 6; a C3Pi-C3OH moiety covalently attached at the 3' terminus.

Provided herein is a double stranded nucleic acid molecule wherein the sense strand (SEQ ID NO:101) includes 2'OMe sugar modified ribonucleotides in positions (5'>3') 4, 11, 13, and 17, optionally a 2'-5' ribonucleotide in position 9, a C3-OH non-nucleotide moiety covalently attached at the 3' and an inverted abasic deoxyribonucleotide moiety covalently attached at the 5' terminus; and the antisense strand (SEQ ID NO:168) includes 2'OMe sugar modified ribonucleotides in positions (5'>3') 1, 8, and 15, a 2'5' ribonucleotide in position 6; a C3Pi-C3OH moiety covalently attached at the 3' terminus.

Provided herein is a double stranded nucleic acid molecule wherein the sense strand (SEQ ID NO:101) includes 2'OMe sugar modified ribonucleotides in positions (5'>3') 4, 11, 13, and 17, optionally a 2'-5' ribonucleotide in position 9, a C3-OH non-nucleotide moiety covalently attached at the 3' and an inverted abasic deoxyribonucleotide moiety covalently attached at the 5' terminus; and the antisense strand (SEQ ID NO:168) includes 2'OMe sugar modified ribonucleotides in positions (5'>3') 1, 4, 8, 13 and 15, a 2'5' ribonucleotide in position 6; a C3Pi-C3OH moiety covalently attached at the 3' terminus.

Provided herein is a double stranded nucleic acid molecule wherein the sense strand (SEQ ID NO:101) includes 2'OMe sugar modified ribonucleotides in positions (5'>3') 4, 11, 13, and 17, a 2'-5' ribonucleotide in position 9, a C3OH non-nucleotide moiety covalently attached at the 3' terminus and an inverted abasic deoxyribonucleotide moiety covalently attached at the 5' terminus; and the antisense strand (SEQ ID NO:168) includes 2'OMe sugar modified ribonucleotides in positions (5'>3') 1, 4, 8, 11 and 15, a 2'5' ribonucleotide in position 6; a C3Pi-C3OH moiety covalently attached at the 3' terminus.

Provided herein is a double stranded nucleic acid molecule wherein the sense strand (SEQ ID NO:101) includes 2'OMe sugar modified ribonucleotides in positions (5'>3') 4, 11, 13, and 17, a 2'-5' ribonucleotide in position 9, a C3OH non-nucleotide moiety covalently attached at the 3' terminus and an inverted abasic deoxyribonucleotide moiety attached at the 5' terminus; and the antisense strand (SEQ ID NO:168) includes 2'OMe sugar modified ribonucleotides in positions (5'>3') 1, 3, 8, 12, 13, and 15; a 2'5' ribonucleotide in position 6; a C3Pi-C3OH moiety covalently attached at the 3' terminus.

In some embodiments the double stranded nucleic acid molecule includes the antisense strand set forth in SEQ ID NO:172 and sense strand set forth in SEQ ID NO:105; identified herein as SERPINH1_51a. In some embodiments the duplex comprises the structure

```
5' ACACCCAUGUGUCUCAGGA-Z 3'    (antisense
   |||||||||||||||||||         SEQ IS NO: 172)
3' Z'-UGUGGGUACACAGAGUCCU-z" 5'   (sense
                                   SEQ ID NO: 105)
``` wherein each "|" represents base pairing between the ribonucleotides;
wherein each of A, C, G and U is independently an unmodified or modified ribonucleotide, or an unconventional moiety;
wherein each of Z and Z' is independently present or absent, but if present is independently 1-5 consecutive nucleotides or non-nucleotide moieties or a combination thereof covalently attached at the 3' terminus of the strand in which it is present; and
wherein z" may be present or absent, but if present is a capping moiety covalently attached at the 5' terminus of the sense strand.

In some embodiments provided is a double stranded nucleic acid molecule wherein the sense strand (SEQ ID NO:105) includes 2'OMe sugar modified pyrimidines, optionally a 2'-5' ribonucleotide in position 9 or 10; a nucleotide or non-nucleotide moiety covalently attached at the 3' terminus and optionally a cap moiety covalently attached at the 5' terminus. In some embodiments the antisense strand (SEQ ID NO:172) includes 2'OMe sugar modified pyrimidine and or purines, a 2'-5' nucleotide in position 5, 6, 7, or 8 (5'>3'); and a nucleotide or non-nucleotide moiety covalently attached at the 3' terminus.

In some embodiments provided is a double stranded nucleic acid molecule wherein the sense strand (SEQ ID NO:105) includes 2'OMe sugar modified pyrimidines in positions (5'>3') 4, 11, 13, and 17, optionally a 2'-5' ribonucleotide in position 9 or 10, a C3Pi or C3OH non-nucleotide moiety covalently attached at the 3' terminus and an inverted abasic deoxyribonucleotide moiety covalently attached at the 5' terminus; and the antisense strand (SEQ ID NO:172) is selected from an antisense strand which includes
a) 2'OMe sugar modified ribonucleotides in positions (5'>3') 8, and 15, a 2'5' ribonucleotide in position 6 or 7; a C3Pi-C3OH moiety covalently attached at the 3' terminus; or
b) 2'OMe sugar modified ribonucleotides in positions (5'>3') 4, 8, 13 and 15, a 2'5' ribonucleotide in position 6 or 7; a C3Pi-C3OH moiety covalently attached at the 3' terminus; or
c) 2'OMe sugar modified ribonucleotides in positions (5'>3') 4, 8, 11 and 15, a 2'5' ribonucleotide in position 6; a C3Pi-C3OH moiety covalently attached at the 3' terminus; or
d) 2'OMe sugar modified ribonucleotides in positions (5'>3') 3, 8, 12, 13, and 15; a 2'5' ribonucleotide in position 6; a C3Pi-C3OH moiety covalently attached at the 3' terminus.

Provided herein is a double stranded nucleic acid molecule wherein the sense strand (SEQ ID NO:105) includes 2'OMe sugar modified ribonucleotides in positions (5'>3') 4, 11, 13, and 17, optionally a 2'-5' ribonucleotide in position 9, a C3-OH non-nucleotide moiety covalently attached at the 3' and an inverted abasic deoxyribonucleotide moiety covalently attached at the 5' terminus; and the antisense strand (SEQ ID NO:172) includes 2'OMe sugar modified ribonucleotides in positions (5'>3')$_8$, and 15, a 2'5' ribonucleotide in position 6; a C3Pi-C3OH moiety covalently attached at the 3' terminus.

Provided herein is a double stranded nucleic acid molecule wherein the sense strand (SEQ ID NO:105) includes 2'OMe sugar modified ribonucleotides in positions (5'>3') 4, 11, 13, and 17, optionally a 2'-5' ribonucleotide in position 9, a C3-OH non-nucleotide moiety covalently attached at the 3' and an inverted abasic deoxyribonucleotide moiety covalently attached at the 5' terminus; and the antisense strand (SEQ ID NO:172) includes 2'OMe sugar modified ribonucleotides in positions (5'>3') 4, 8, 13 and 15, a 2'5' ribonucleotide in position 6; a C3Pi-C3OH moiety covalently attached at the 3' terminus.

Provided herein is a double stranded nucleic acid molecule wherein the sense strand (SEQ ID NO:105) includes 2'OMe sugar modified ribonucleotides in positions (5'>3') 4, 11, 13, and 17, a 2'-5' ribonucleotide in position 9, a C3-OH non-nucleotide moiety covalently attached at the 3' terminus and an inverted abasic deoxyribonucleotide moiety covalently attached at the 5' terminus; and the antisense strand (SEQ ID NO:172) includes 2'OMe sugar modified ribonucleotides in positions (5'>3') 4, 8, 11 and 15, a 2'5' ribonucleotide in position 6; a C3Pi-C3OH moiety covalently attached at the 3' terminus.

Provided herein is a double stranded nucleic acid molecule wherein the sense strand (SEQ ID NO:105) includes 2'OMe sugar modified ribonucleotides in positions (5'>3') 4, 11, 13, and 17, a 2'-5' ribonucleotide in position 9, a C3OH non-nucleotide moiety covalently attached at the 3' terminus and an inverted abasic deoxyribonucleotide moiety covalently attached at the 5' terminus; and the antisense strand (SEQ ID NO:172) includes 2'OMe sugar modified ribonucleotides in positions (5'>3") 3, 8, 12, 13, and 15; a 2'5' ribonucleotide in position 6; a C3Pi-C3OH moiety covalently attached at the 3' terminus.

In some embodiments the antisense and sense strands are selected from the oligonucleotide pairs set forth in Table A-19 and identified herein as SERPINH1_4 (SEQ ID NOS: 195 and 220) and SERPINH1_12 (SEQ ID NOS: 196 and 221).

In some embodiments the double stranded nucleic acid molecule includes the antisense strand set forth in SEQ ID NO:220 and sense strand set forth in SEQ ID NO:194; identified herein as SERPINH1_4. In some embodiments the double stranded nucleic acid molecule has the structure

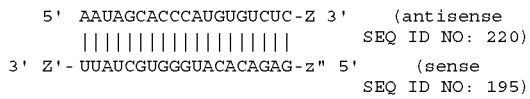

```
5'  AAUAGCACCCAUGUGUCUC-Z 3'      (antisense
    ||||||||||||||||||            SEQ ID NO: 220)
3' Z'-UUAUCGUGGGUACACAGAG-z" 5'   (sense
                                  SEQ ID NO: 195)
``` wherein each "|" represents base pairing between the ribonucleotides;
wherein each of A, C, G, U is independently an unmodified or modified ribonucleotide, or an unconventional moiety;
wherein each of Z and Z' is independently present or absent, but if present is independently 1-5 consecutive nucleotides or non-nucleotide moieties or a combination thereof covalently attached at the 3' terminus of the strand in which it is present; and
wherein z" may be present or absent, but if present is a capping moiety covalently attached at the 5' terminus of N2-(N')y.

In some embodiments provided is a double stranded nucleic acid molecule wherein the antisense strand (SEQ ID NO:220) includes 2'OMe sugar modified ribonucleotides in positions (5'>3') 3, 5, 9, 11, 15, 17 and 19, a 2'-5' ribonucleotide in position 7, and a C3Pi-C3OH moiety covalently attached to the 3' terminus; and the sense strand (SEQ ID NO:195) is selected from a sense strand which includes
a) 2'-5' ribonucleotides in positions 15, 16, 17, 18 and 19, a C3OH moiety covalently attached to the 3' terminus; and an inverted abasic deoxyribonucleotide moiety covalently attached at the 5' terminus; or
b) 2'-5' ribonucleotides in positions 15, 16, 17, 18 and 19, a 3' terminal phosphate; and an inverted abasic deoxyribonucleotide moiety covalently attached at the 5' terminus; or
c) 2'OMe sugar modified ribonucleotides in positions (5'>3') 5, 7, 13, and 16; a 2'5' ribonucleotide in position 18; a C3OH moiety covalently attached at the 3' terminus; and an inverted abasic deoxyribonucleotide moiety covalently attached at the 5' terminus; or
d) 2'OMe sugar modified ribonucleotides in positions (5'>3') 7, 13, 16 and 18; a 2'5' ribonucleotide in position 9; a C3OH moiety covalently attached at the 3' terminus; and an inverted abasic deoxyribonucleotide moiety covalently attached at the 5' terminus; or
e) 2'-5' ribonucleotides in positions 15, 16, 17, 18, and 19: a C3Pi moiety covalently attached at the 3' terminus; and an inverted abasic deoxyribonucleotide moiety covalently attached at the 5' terminus.

Provided herein is a double stranded nucleic acid molecule wherein the antisense strand (SEQ ID NO:220) includes 2'OMe sugar modified ribonucleotides in positions (5'>3') 3, 5, 9, 11, 15, 17, 19, a 2'-5' ribonucleotide in position 7 and a C3Pi-C3OH moiety covalently attached to the 3' terminus; and the sense strand (SEQ ID NO:195) includes 2'-5' ribonucleotides in positions 15, 16, 17, 18, and 19: a C3 moiety covalently attached to the 3' terminus; and an inverted abasic deoxyribonucleotide moiety covalently attached at the 5' terminus.

Provided herein is a double stranded nucleic acid molecule wherein the antisense strand (SEQ ID NO:220) includes 2'OMe sugar modified ribonucleotides in positions (5'>3') 3, 5, 9, 11, 15, 17, 19, a 2'-5' ribonucleotide in position 7 and a C3Pi-C3OH moiety covalently attached to the 3' terminus; and the sense strand (SEQ ID NO:195) includes 2'-5' ribonucleotides in positions 15, 16, 17, 18, and 19: a 3' terminal phosphate; and an inverted abasic deoxyribonucleotide moiety covalently attached at the 5' terminus.

Provided herein is a double stranded nucleic acid molecule wherein the antisense strand (SEQ ID NO:220) includes 2'OMe sugar modified ribonucleotides in positions (5'>3') 3, 5, 9, 11, 15, 17, 19, a 2'-5' ribonucleotide in position 7 and a C3Pi-C3OH moiety covalently attached to the 3' terminus; and the sense strand (SEQ ID NO:195) includes 2'OMe sugar modified ribonucleotides in positions (5'>3') 5, 7, 13, and 16; a 2'-5' ribonucleotide in position 18; a C3OH moiety covalently attached at the 3' terminus; and an inverted abasic deoxyribonucleotide moiety covalently attached at the 5' terminus.

Provided herein is a double stranded nucleic acid molecule wherein the antisense strand (SEQ ID NO:220) includes 2'OMe sugar modified ribonucleotides in positions (5'>3') 3, 5, 9, 11, 15, 17, 19, a 2'-5' ribonucleotide in position 7 and a C3Pi-C3OH moiety covalently attached to the 3' terminus; and the sense strand (SEQ ID NO:195) includes 2'OMe sugar modified ribonucleotides in positions (5'>3') 7, 13, 16 and 18; a 2'-5' ribonucleotide in position 9; a C3OH moiety covalently attached at the 3' terminus; and an inverted abasic deoxyribonucleotide moiety covalently attached at the 5' terminus.

Provided herein is a double stranded nucleic acid molecule wherein the antisense strand (SEQ ID NO:220) includes 2'OMe sugar modified ribonucleotides in positions (5'>3') 3, 5, 9, 11, 15, 17, 19, a ribonucleotide in position 7 and a C3Pi-C3OH moiety covalently attached to the 3' terminus; and the sense strand (SEQ ID NO:195) includes 2'-5' ribonucleotides in positions 15, 16, 17, 18, and 19: a C3Pi moiety covalently attached at the 3' terminus; and an inverted abasic deoxyribonucleotide moiety covalently attached at the 5' terminus.

In some embodiments provided herein is a double stranded nucleic acid molecule wherein the antisense strand (SEQ ID NO:220) includes 2'OMe sugar modified ribonucleotides in positions (5'>3') 1, 3, 5, 9, 11, 13, 15, 17, 19 and a C3Pi-C3OH moiety covalently attached to the 3' terminus; and the sense strand (SEQ ID NO:195) includes 2'OMe sugar modified ribonucleotides in positions (5'>3') 7, 9, 13, 16 and 18; and an inverted abasic deoxyribonucleotide moiety covalently attached at the 5' terminus.

In some embodiments provided herein is a double stranded nucleic acid molecule wherein the sense strand (SEQ ID NO:195) includes 2'-5' ribonucleotides in positions 15, 16, 17, 18, and 19: a 3' terminal phosphate and an inverted abasic deoxyribonucleotide moiety covalently attached at the 5' terminus and the antisense strand (SEQ ID NO:220) includes an antisense strand selected from one of a) 2'OMe sugar modified ribonucleotides in positions (5'>3') 3, 5, 7, 9, 11, 13, 15, 17, 19 and a C3Pi-C3OH moiety covalently attached to the 3' terminus; or b) 2'OMe sugar modified ribonucleotides in positions (5'>3') 1, 3, 6, 8, 10, 12, 14, 17, 18 and a C3Pi-C3OH moiety covalently attached to the 3' terminus.

In some embodiments provided herein is a double stranded nucleic acid molecule which includes the antisense strand set forth in SEQ ID NO:130 and the sense strand set forth in SEQ ID NO:63; identified herein as SERPINH1_12. In some embodiments the duplex comprises the structure

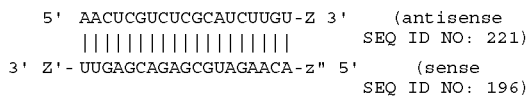

```
5'  AACUCGUCUCGCAUCUUGU-Z 3'   (antisense
    ||||||||||||||||||          SEQ ID NO: 221)
3' Z'- UUGAGCAGAGCGUAGAACA-z" 5'  (sense
                                 SEQ ID NO: 196)
``` wherein each "|" represents base pairing between the ribonucleotides;
wherein each of A, C, G, U is independently an unmodified or modified ribonucleotide, or an unconventional moiety;
wherein each of Z and Z' is independently present or absent, but if present is independently 1-consecutive nucleotides or non-nucleotide moieties or a combination thereof covalently attached at the 3' terminus of the strand in which it is present; and
wherein z" may be present or absent, but if present is a capping moiety covalently attached at the 5' terminus of N2-(N')y.

In some embodiments provided is a double stranded nucleic acid molecule wherein the sense strand (SEQ ID NO:196) includes one or more 2'OMe sugar modified pyrimidines; a 3' terminal nucleotide or non-nucleotide overhang; and a cap moiety covalently attached at the 5' terminus. In some embodiments the antisense strand (SEQ ID NO:221) includes one or more 2'OMe sugar modified pyrimidines, a nucleotide or non-nucleotide moiety covalently attached at the 3' terminus, and a cap moiety covalently attached at the 5' terminus.

In some embodiments provided is a double stranded nucleic acid molecule wherein the sense strand (SEQ ID NO:196) includes 2'OMe sugar modified ribonucleotides in positions (5'>3') 2, 14 and 18; a C3OH moiety covalently attached at the 3' terminus; and an inverted abasic deoxyribonucleotide moiety covalently attached at the 5' terminus; and the antisense strand (SEQ ID NO:221) is selected from an antisense strand which includes a) 2'OMe sugar modified ribonucleotides in positions (5'>3') 3, 5, 9, 11, 13, 15 and 17; a 2'-5' ribonucleotide in position 7; and a C3Pi-C3OH moiety covalently attached to the 3' terminus; or b) 2'OMe sugar modified ribonucleotides in positions (5'>3') 3, 5, 7, 9, 12, 13 and 17; a 2'-5' ribonucleotide in position 7; and a C3Pi-C3OH moiety covalently attached to the 3' terminus.

In some embodiments provided is a double stranded nucleic acid molecule wherein the sense strand (SEQ ID NO:196) includes 2'OMe sugar modified ribonucleotides in positions (5'>3') 2, 14 and 18; a C3-OH moiety covalently attached at the 3' terminus; and an inverted abasic deoxyribonucleotide moiety covalently attached at the 5' terminus; and the antisense strand (SEQ ID NO:221) includes 2'OMe sugar modified ribonucleotides in positions (5'>3') 3, 5, 9, 11, 13, 15 and 17; a ribonucleotide in position 7; and a C3Pi-C3OH moiety covalently attached to the 3' terminus.

In some embodiments provided is a duplex oligonucleotide molecule wherein the sense strand (SEQ ID NO:196) includes 2'OMe sugar modified ribonucleotides in positions (5'>3') 14 and 18 and optionally in position 2; a C3-OH moiety covalently attached at the 3' terminus; and an inverted abasic deoxyribonucleotide moiety covalently attached at the 5' terminus; and the antisense strand (SEQ ID NO:221) includes 2'OMe sugar modified ribonucleotides in positions (5'>3') 3, 5, 7, 9, 12, 13, and 17; a 2'-5' ribonucleotide in position 7; and a C3Pi-C3OH moiety covalently attached to the 3' terminus.

In some embodiments provided is a duplex oligonucleotide molecule wherein the sense strand (SEQ ID NO:196) includes 2'OMe sugar modified ribonucleotides in positions (5'>3') 14 and 18; a C3-OH moiety covalently attached at the 3' terminus; and an inverted abasic deoxyribonucleotide moiety covalently attached at the 5' terminus; and the antisense strand (SEQ ID NO:221) is selected from an antisense strand which includes a) 2'OMe sugar modified ribonucleotides in positions (5'>3') 3, 5, 9, 11, 13, 15 and 17; a 2'-5' ribonucleotide in position 7; and a C3Pi-C3OH moiety covalently attached to the 3' terminus; or b) 2'OMe sugar modified ribonucleotides in positions (5'>3') 3, 5, 7, 9, 12, 13 and 17; a 2'-5' ribonucleotide in position 7; and a C3Pi-C3OH moiety covalently attached to the 3' terminus.

Provided herein is a double stranded nucleic acid molecule wherein the sense strand (SEQ ID NO:196) includes 2'OMe sugar modified ribonucleotides in positions (5'>3') 14 and 18; a C3-OH moiety covalently attached at the 3' terminus; and an inverted abasic deoxyribonucleotide moiety covalently attached at the 5' terminus; and the antisense strand (SEQ ID NO:220) includes 2'OMe sugar modified ribonucleotides in positions (5'>3') 1, 3, 5, 9, 11, 13, 15 and 17; a 2'-5' ribonucleotide in position 7; and a C3Pi-C3OH moiety covalently attached to the 3' terminus.

Provided herein is a double stranded nucleic acid molecule wherein the sense strand (SEQ ID NO:196) includes 2'OMe sugar modified ribonucleotides in positions (5'>3') 14 and 18; a C3-OH moiety covalently attached at the 3' terminus; and an inverted abasic deoxyribonucleotide moiety covalently attached at the 5' terminus; and the antisense strand (SEQ ID NO:220) includes 2'OMe sugar modified ribonucleotides in positions (5'>3') 1, 3, 5, 7, 9, 12, 13, and 17; a 2'-5' ribonucleotide in position 7; and a C3Pi-C3OH moiety covalently attached to the 3' terminus.

In further embodiments of Structures A1 and A2 (N')y includes 1-8 modified ribonucleotides wherein the modified ribonucleotide is a DNA nucleotide. In certain embodiments (N')y includes 1, 2, 3, 4, 5, 6, 7, or up to 8 DNA moieties.

In some embodiments either Z or Z' is present and independently includes two non-nucleotide moieties.

In additional embodiments Z and Z' are present and each independently includes two non-nucleotide moieties.

In some embodiments each of Z and Z' includes an abasic moiety, for example a deoxyriboabasic moiety (referred to herein as "dAb") or riboabasic moiety (referred to herein as "rAb"). In some embodiments each of Z and/or Z' includes two covalently linked abasic moieties and is for example dAb-dAb or rAb-rAb or dAb-rAb or rAb-dAb, wherein each moiety is covalently attached to an adjacent moiety, preferably via a phospho-based bond. In some embodiments the phospho-based bond includes a phosphorothioate, a phosphonoacetate or a phosphodiester bond. In preferred embodiments the phospho-based bond includes a phosphodiester bond.

In some embodiments each of Z and/or Z' independently includes an alkyl moiety, optionally propane [(CH2)3] moiety (C3) or a derivative thereof including propanol (C3-OH) and phospho derivative of propanediol ("C3-3'Pi"). In some embodiments each of Z and/or Z' includes two alkyl moieties covalently linked to the 3' terminus of the antisense strand or sense strand via a phosphodiester or phosphorothioate linkage and covalently linked to one another via a phosphodiester or phosphorothioate linkage and in some examples is C3Pi-C3Pi or C3Pi-C3OH. The 3' terminus of the antisense strand and/or the 3' terminus of the sense strand is covalently attached to a C3 moiety via a phospho-based bond and the C3 moiety is covalently conjugated a C3-OH moiety via a phospho-based bond. In some embodiments the phospho-based bonds include a phosphorothioate, a phosphonoacetate or a phosphodiester bond. In preferred embodiments the phospho-based bond includes a phosphodiester bond.

In various embodiments of Structure A1 or Structure A2, Z and Z' are absent. In other embodiments Z or Z' is present. In some embodiments each of Z and/or Z' independently includes a C2, C3, C4, C5 or C6 alkyl moiety, optionally a C3 [propane, —(CH2)$_3$-] moiety or a derivative thereof including propanol (C3-OH/C3OH), propanediol, and phosphodiester derivative of propanediol ("C3Pi"). In preferred embodiments each of Z and/or Z' includes two hydrocarbon moieties and in some examples is C3Pi-C3OH or C3Pi-C3Pi. Each C3 is covalently conjugated to an adjacent C3 via a covalent bond, preferably a phospho-based bond. In some embodiments the phospho-based bond is a phosphorothioate, a phosphonoacetate or a phosphodiester bond.

In specific embodiments x=y=19 and Z comprises at least one C3 alkyl overhang. In some embodiments the C3-C3 overhang is covalently attached to the 3' terminus of (N)x or (N')y via a covalent linkage, preferably a phosphodiester linkage. In some embodiments the linkage between a first C3 and a second C3 is a phosphodiester linkage. In some embodiments the 3' non-nucleotide overhang is C3Pi-C3Pi. In some embodiments the 3' non-nucleotide overhang is C3Pi-C3Ps. In some embodiments the 3' non-nucleotide overhang is C3Pi-C3OH (OH is hydroxy). In some embodiments the 3' non-nucleotide overhang is C3Pi-C3OH.

In various embodiments the alkyl moiety comprises an alkyl derivative including a C3 alkyl, C4 alkyl, C5 alkyl or C6 alkyl moiety comprising a terminal hydroxyl, a terminal amino, or terminal phosphate group. In some embodiments the alkyl moiety is a C3 alkyl or C3 alkyl derivative moiety. In some embodiments the C3 alkyl moiety comprises propanol, propylphosphate, propylphosphorothioate or a combination thereof. The C3 alkyl moiety is covalently linked to the 3' terminus of (N')y and/or the 3' terminus of (N)x via a phosphodiester bond. In some embodiments the alkyl moiety comprises propanol, propyl phosphate or propyl phosphorothioate. In some embodiments each of Z and Z' is independently selected from propanol, propyl phosphate propyl phosphorothioate, combinations thereof or multiples thereof in particular 2 or 3 covalently linked propanol, propyl phosphate, propyl phosphorothioate or combinations thereof. In some embodiments each of Z and Z' is independently selected from propyl phosphate, propyl phosphorothioate, propyl phospho-propanol; propyl phospho-propyl phosphorothioate; propylphospho-propyl phosphate; (propyl phosphate)$_3$, (propyl phosphate)$_2$-propanol, (propyl phosphate)$_2$-propyl phosphorothioate. Any propane or propanol conjugated moiety can be included in Z or Z'.

The structures of exemplary 3' terminal non-nucleotide moieties are as follows:

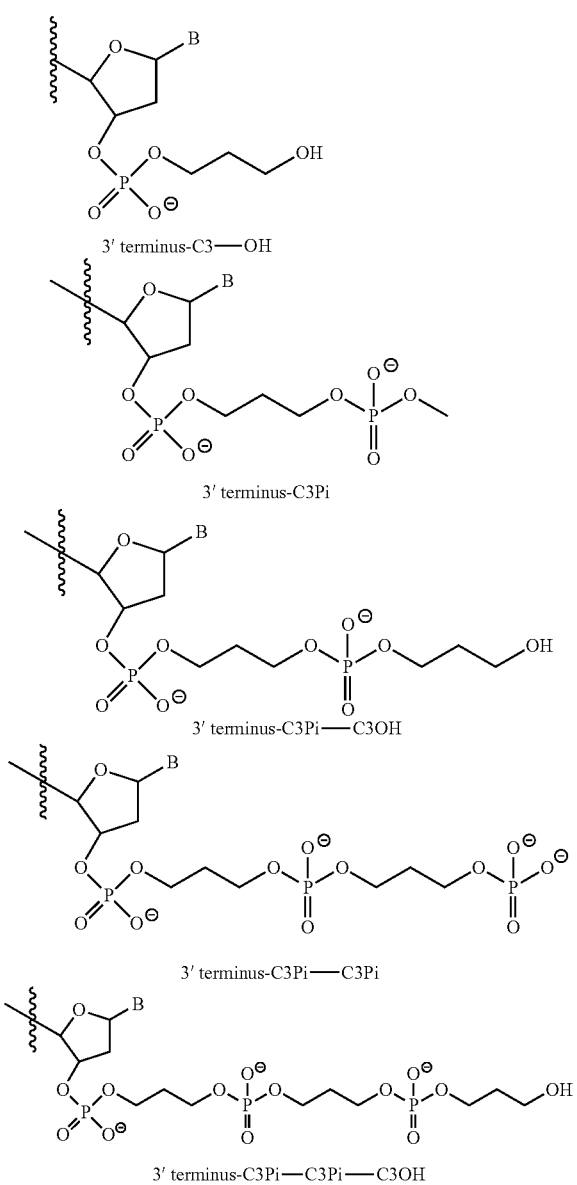

In some embodiments each of Z and Z' is independently selected from propanol, propyl phosphate, propyl phosphorothioate, combinations thereof or multiples thereof.

In some embodiments each of Z and Z' is independently selected from propyl phosphate, propyl phosphorothioate, propyl phospho-propanol; propyl phospho-propyl phosphorothioate; propylphospho-propyl phosphate; (propyl phosphate)3, (propyl phosphate)2-propanol, (propyl phosphate)2-propyl phosphorothioate. Any propane or propanol conjugated moiety can be included in Z or Z'.

In additional embodiments each of Z and/or Z' includes a combination of an abasic moiety and an unmodified deoxyribonucleotide or ribonucleotide or a combination of a hydrocarbon moiety and an unmodified deoxyribonucleotide or ribonucleotide or a combination of an abasic moiety (deoxyribo or ribo) and a hydrocarbon moiety. In such embodiments, each of Z and/or Z' includes C3-rAb or C3-dAb wherein each moiety is covalently bond to the adjacent moiety vi a phospho-based bond, preferably a phosphodiester, phosphorothioate or phosphonoacetate bond.

In certain embodiments nucleic acid molecules as disclosed herein include a sense oligonucleotide sequence selected from any one of Oligo #s 2-67 or 68-92, shown infra in Tables A-18 and A-19, respectfully.

In certain preferred embodiments compounds provided include Compound_1, Compound_2, Compound_3, Compound_4, Compound_5, Compound_6, Compound_7, Compound_8 and Compound_9 as described herein.

In some embodiments (such as, for example, Compound_1, Compound_5 and Compound_6 as described herein) provided are 19 mer double stranded nucleic acid molecules wherein the antisense strand is SEQ ID NO:127 and the sense strand is SEQ ID NO:60. In certain embodiments, provided are 19 mer double stranded nucleic acid molecules wherein the antisense strand is SEQ ID NO:127 and includes 2'OMe sugar modified ribonucleotides, a ribonucleotide in at least one of positions 1, 5, 6, or 7, and a 3' terminal non-nucleotide moiety covalently attached to the 3' terminus; and the sense strand is SEQ ID NO:60 and includes at least one 2'5' ribonucleotide or 2'OMe modified ribonucleotide, a non-nucleotide moiety covalently attached at the 3' terminus and a cap moiety covalently attached at the 5' terminus. In some embodiments, provided are 19 mer double stranded nucleic acid molecule wherein the antisense strand is SEQ ID NO:127 and includes 2'OMe sugar modified ribonucleotides at positions 3, 5, 9, 11, 13, 15, 17, and 19 (5'>3'), a 2'-5' ribonucleotide in position 7, and a 3' terminal C3OH non-nucleotide moiety covalently attached at the 3' terminus; and the sense strand is SEQ ID NO:60 and includes 5 consecutive 2'5' ribonucleotides in the 3' terminal positions 15, 16, 17, 18, and 19 (5'>3'), a C3Pi non-nucleotide moiety covalently attached at the 3' terminus and an inverted abasic moiety covalently attached at the 5' terminus.

In one embodiment provided is Compound_1 that is a 19 mer double stranded nucleic acid molecule wherein the antisense strand is SEQ ID NO:127 and includes 2'OMe sugar modified ribonucleotides at positions 3, 5, 9, 11, 13, 15, 17, and 19 (5'>3'), a 2'-5' ribonucleotide in position 7, and a C3Pi-C3OH non-nucleotide moiety covalently attached at the 3' terminus; and the sense strand is SEQ ID NO:60 and includes 5 consecutive 2'5' ribonucleotides in the 3' terminal positions 15, 16, 17, 18, and 19 (5'>3'), a C3Pi non-nucleotide moiety covalently attached at the 3' terminus and an inverted abasic moiety covalently attached at the 5' terminus; and that further includes a 2'OMe sugar modified ribonucleotide at position 1 of the antisense strand.

In one embodiment, provided is Compound_6 that is a 19 mer double stranded nucleic acid molecule wherein the antisense strand is SEQ ID NO:127 and includes 2'OMe sugar modified ribonucleotides at positions 3, 5, 9, 11, 13, 15, 17, and 19 (5'>3'), a 2'-5' ribonucleotide in position 7, and a C3Pi-C3OH non-nucleotide moiety covalently attached at the 3' terminus; and the sense strand is SEQ ID NO:60 and includes 5 consecutive 2'5' ribonucleotides in the 3' terminal positions 15, 16, 17, 18, and 19 (5'>3'), a C3Pi non-nucleotide moiety covalently attached at the 3' terminus and an inverted abasic moiety covalently attached at the 5' terminus; and that further includes a 2'5' ribonucleotide at position 1 of the antisense strand.

In one embodiment, provided is Compound_5 that is a 19 mer double stranded nucleic acid molecule wherein the antisense strand is SEQ ID NO:127 and includes 2'OMe sugar modified ribonucleotides in positions 1, 3, 5, 9, 11, 13, 15, 17, and 19 (5'>3'), a 2'-5' ribonucleotide in position 7, and a C3Pi-C3OH non-nucleotide moiety covalently attached at the 3' terminus; and the sense strand is SEQ ID NO:60 and includes 2'OMe sugar modified ribonucleotides in positions (5'>3') 7, 13, 16 and 18, a 2'5' ribonucleotide at position 9, a C3OH non-nucleotide moiety covalently attached at the 3' terminus and an inverted abasic moiety covalently attached at the 5' terminus.

In some embodiments (such as, for example, Compound_2, and Compound_7 as described herein) provided are 19 mer double stranded nucleic acid molecules wherein the sense strand is SEQ ID NO:63 and the antisense strand is SEQ ID NO:130. In some embodiments provided are 19-mer double stranded nucleic acid molecules wherein the sense strand is SEQ ID NO:63 and includes 2'OMe sugar modified pyrimidine ribonucleotides; a non-nucleotide moiety covalently attached at the 3' terminus; and a cap moiety covalently attached at the 5' terminus; and the antisense strand is SEQ ID NO:130 and includes 2'OMe sugar modified ribonucleotides; a 2'-5' ribonucleotide at position 7; and a non-nucleotide moiety covalently attached at the 3' terminus. In some embodiments provided are 19-mer double stranded nucleic acid molecules wherein the sense strand is SEQ ID NO:63 and includes 2'OMe sugar modified ribonucleotides, a non-nucleotide moiety covalently attached at the 3' terminus, and a cap moiety covalently attached at the 5' terminus; and the antisense strand is SEQ ID NO:130 and includes 2'OMe sugar modified ribonucleotides; a ribonucleotide in at least one of positions 5, 6 or 7; and a non-nucleotide moiety covalently attached at the 3' terminus.

In one embodiment, provided is Compound_2 that is a 19-mer double stranded nucleic acid molecule wherein the sense strand is SEQ ID NO:63 and includes 2'OMe sugar modified ribonucleotides in positions (5'>3') 2, 14 and 18; a C3OH moiety covalently attached at the 3' terminus; and an inverted abasic deoxyribonucleotide moiety covalently attached at the 5' terminus; and the antisense strand is SEQ ID NO:130 and includes 2'OMe sugar modified ribonucleotides in positions (5'>3') 1, 3, 5, 9, 12, 13, and 17; a 2'-5' ribonucleotide in at least one of positions 5, 6 or 7; and C3Pi-C3OH non-nucleotide moiety covalently attached at the 3' terminus.

In one embodiment, provided is Compound_7 that is a 19-mer double stranded nucleic acid molecule wherein the sense strand is SEQ ID NO:63 and includes 2'OMe sugar modified ribonucleotides in positions (5'>3') 2, 14 and 18; a C3OH moiety covalently attached at the 3' terminus; and an inverted abasic deoxyribonucleotide moiety covalently attached at the 5' terminus; and the antisense strand is SEQ ID NO:130 and includes 2'OMe sugar modified ribonucleotides in positions (5'>3') 1, 3, 5, 9, 11, 13, and 17; a 2'-5' ribonucleotide at position 7; and a C3Pi-C3OH non-nucleotide moiety covalently attached at the 3' terminus.

In some embodiments (such as, for example, Compound_3 as described herein) provided are 19 mer double stranded nucleic acid molecules wherein the sense strand is SEQ ID NO:98 and the antisense strand is SEQ ID NO:165. In some embodiments, provided are 19-mer double stranded nucleic acid molecules wherein the sense strand is SEQ ID NO:98 and includes 2'-5' ribonucleotides in positions at the 3' terminus: a non-nucleotide moiety covalently attached at the 3' terminus and a cap moiety covalently attached at the 5' terminus; and the antisense strand is SEQ ID NO:165 and includes 2'OMe sugar modified ribonucleotides; a 2'-5' ribonucleotide in at least one of positions 5, 6 or 7 and a non-nucleotide moiety covalently attached at the 3' terminus. In one embodiment, provided is Compound_3 that is a 19-mer double stranded nucleic acid molecule wherein the sense strand is SEQ ID NO:98 and includes 2'-5' ribonucleotides in positions (5'>3') 15, 16, 17, 18, and 19: a C3-OH 3' moiety covalently attached at the 3' terminus and an inverted abasic deoxyribonucleotide moiety covalently attached at the 5' terminus; and the antisense strand is SEQ ID NO:165 and includes 2'OMe sugar modified ribonucleotides in positions (5'>3') 2, 4, 6, 8, 11, 13, 15, 17, and 19; a 2'-5' ribonucleotide in position 7 and a C3Pi-C3OH covalently attached at the 3' terminus.

In some embodiments (such as, for example, Compound_4, Compound_8 and Compound_9 described herein) provided are 19-mer double stranded nucleic acid molecules wherein the sense strand is SEQ ID NO:101 and the antisense strand is SEQ ID NO:168. In some embodiments provided are 19-mer double stranded nucleic acid molecules wherein the sense strand is SEQ ID NO:101 and includes 2'OMe sugar modified pyrimidine ribonucleotides, an optional ribonucleotide in one of position 9 or 10, a non-nucleotide moiety covalently attached at the 3' terminus and a cap moiety covalently attached at the 5' terminus; and the antisense strand is SEQ ID NO:168 and includes 2'OMe sugar modified ribonucleotides, a 2'5' ribonucleotide in at least one of positions 5, 6, or 7; and a non-nucleotide moiety covalently attached at the 3' terminus.

In one embodiment, provided is Compound 4 that is a 19-mer double stranded nucleic acid molecule wherein sense strand is SEQ ID NO:101 and includes 2'OMe sugar modified ribonucleotides in positions (5'>3') 4, 11, 13, and 17, a 2'-5' ribonucleotide in position 9, a C3OH non-nucleotide moiety covalently attached at the 3' terminus and an inverted abasic deoxyribonucleotide moiety covalently attached at the 5' terminus; and the antisense strand is SEQ ID NO:168 and includes 2'OMe sugar modified ribonucleotides in positions (5'>3') 1, 4, 8, 11 and 15, a 2'5' ribonucleotide in position 6; a 3' C3Pi-C3OH overhang covalently attached at the 3' terminus.

In one embodiment, provided is Compound_8 that is a 19-mer double stranded nucleic acid molecule wherein sense strand is SEQ ID NO:101 and includes 2'OMe sugar modified ribonucleotides in positions (5'>3') 4, 11, 13, and 17, a C3OH non-nucleotide moiety covalently attached at the 3' terminus and an inverted abasic deoxyribonucleotide moiety covalently attached at the 5' terminus; and the antisense strand is SEQ ID NO:168 and includes 2'OMe sugar modified ribonucleotides in positions (5'>3') 1, 4, 8, 13 and 15, a 2'5' ribonucleotide in position 6; and a 3' C3Pi-C3OH overhang covalently attached at the 3' terminus.

In one embodiment, provided is Compound_9 that is a 19-mer double stranded nucleic acid molecule wherein the sense strand is SEQ ID NO:101 and includes 2'OMe sugar modified ribonucleotides in positions (5'>3') 2, 4, 11, 13, and 17, a C3OH non-nucleotide moiety covalently attached at the 3' terminus and an inverted abasic deoxyribonucleotide moiety covalently attached at the 5' terminus; and the antisense strand is SEQ ID NO:168 and includes 2'OMe sugar modified ribonucleotides in positions (5'>3') 1, 4, 8, 11 and 15, a 2'5' ribonucleotide in position 6; a 3' C3Pi-C3OH non-nucleotide moiety covalently attached at the 3' terminus.

In another aspect, provided are methods for reducing the expression of hsp47 in a cell by introducing into a cell a nucleic acid molecule as provided herein in an amount sufficient to reduce expression of hsp47. In one embodiment, the cell is hepatocellular stellate cell. In another embodiment, the cell is a stellate cell in renal or pulmonary tissue. In certain embodiments, the method is performed in vitro, in other embodiments, the method is performed in vivo.

In yet another aspect, provided are methods for treating an individual suffering from a disease associated with hsp47. The methods include administering to the individual a nucleic acid molecule such as provided herein in an amount sufficient to reduce expression of hsp47. In certain embodiments the disease associated with hsp47 is a disease selected from the group consisting of liver fibrosis, cirrhosis, pulmonary fibrosis including lung fibrosis (including ILF), any condition causing kidney fibrosis (e.g., CKD including ESRD), peritoneal fibrosis, chronic hepatic damage, fibrillogenesis, fibrotic diseases in other organs, abnormal scarring (keloids) associated with all possible types of skin injury accidental and jatrogenic (operations); scleroderma; cardiofibrosis, failure of glaucoma filtering operation; and intestinal adhesions. In some embodiments, the compounds may be useful in treating organ-specific indications, for example indications including those shown in Table 2 below:

TABLE 2

| Organ | Indication |
|---|---|
| Skin | Pathologic scarring as keloid and hypertrophic scar |
| | Surgical scarring |
| | Injury scarring |
| | keloid, or nephrogenic fibrosing dermatopathy |
| Peritoneum | Peritoneal fibrosis |
| | Adhesions |
| | Peritoneal Sclerosis associated with continual ambulatory peritoneal dialysis (CAPD) |
| Liver | Cirrhosis including post-hepatitis C cirrhosis, primary biliary cirrhosis |
| | Liver fibrosis, e.g. Prevention of Liver Fibrosis in Hepatitis C carriers |
| | schistomasomiasis |
| | cholangitis |
| | Liver cirrhosis due to Hepatitis C post liver transplant or Non-Alcoholic Steatohepatitis (NASH) |
| Pancreas | inter(peri)lobular fibrosis (as in alcoholic chronic pancreatitis), periductal fibrosis (as in hereditary pancreatitis), periductal and interlobular fibrosis (as in autoimmune pancreatitis), diffuse inter- and intralobular fibrosis (as in obstructive chronic pancreatitis) |

TABLE 2-continued

| Organ | Indication |
|---|---|
| Kidney | Chronic Kidney Disease (CKD) of any etiology. Treatment of early stage CKD (elevated SCr) in diabetic patients ("prevent" further deterioration in renal function)<br>kidney fibrosis associated with lupus glomeruloschelerosis<br>Diabetic Nephropathy |
| Heart | Congestive heart failure,<br>Endomyocardial fibrosis,<br>cardiofibrosis<br>fibrosis associated with myocardial infarction |
| Lung | Asthma, Idiopathic pulmonary fibrosis (IPF);<br>Interstitial lung fibrosis (ILF)<br>Radiation Pneumonitis leading to Pulmonary Fibrosis (e.g. due to cancer treating radiation) |
| Bone marrow | Myeloproliferative disorders: Myelofibrosis (MF), Polycythemia vera (PV), Essential thrombocythemia (ET)<br>idiopathic myelofibrosis<br>drug induced myelofibrosis. |
| Eye | Anterior segment: Corneal opacification e,g, following inherited dystrophies, herpetic keratitis or pterygia; Glaucoma<br>Posterior segment fibrosis and traction retinal detachment, a complication of advanced diabetic retinopathy (DR); Fibrovascular scarring and gliosis in the retina;<br>Under the retina fibrosis for example subsequent to subretinal hemorrhage associated with neovascular AMD<br>Retro-orbital fibrosis, postcataract surgery, proliferative vitreoretinopathy.<br>Ocular cicatricial pemphigoid |
| Intestine | Intestinal fibrosis, Crohn's disease |
| Vocal cord | Vocal cord scarring, vocal cord mucosal fibrosis, laryngeal fibrosis |
| Vasculature | Atherosclerosis, postangioplasty arterial restenosis |
| Multisystemic | Scleroderma systemic sclerosis; multifocal fibrosclerosis; sclerodermatous graft-versus-host disease in bone marrow transplant recipients, and nephrogenic systemic fibrosis (exposure to gadolinium-based contrast agents (GBCAs), 30% of MRIs) |
| Malignancies of various origin | Metastatic and invasive cancer by inhibiting function of activated tumor associated myofibroblasts |

In some embodiments the preferred indications include, Liver cirrhosis due to Hepatitis C post liver transplant; Liver cirrhosis due to\ Non-Alcoholic Steatohepatitis (NASH); Idiopathic Pulmonary Fibrosis; Radiation Pneumonitis leading to Pulmonary Fibrosis; Diabetic Nephropathy; Peritoneal Sclerosis associated with continual ambulatory peritoneal dialysis (CAPD) and Ocular cicatricial pemphigoid.

Fibrotic Liver indications include Alcoholic Cirrhosis, Hepatitis B cirrhosis, Hepatitis C cirrhosis, Hepatitis C (Hep C) cirrhosis post orthotopic liver transplant (OLTX), NASH/ NAFLD, Primary biliary cirrhosis (PBC), Primary sclerosing cholangitis (PSC), Biliary atresia, alpha1 antitrypsin deficiency (A1AD), Copper storage diseases (Wilson's disease), Fructosemia, Galactosemia, Glycogen storage diseases (especially types III, IV, VI, IX, and X), Iron-overload syndromes (hemochromatosis), Lipid abnormalities (e.g., Gaucher's disease). Peroxisomal disorders (eg, Zellweger syndrome), Tyrosinemia, Congenital hepatic fibrosis, Bacterial Infections (eg, brucellosis), Parasitic (eg, echinococcosis), Budd-Chiari syndrome (hepatic veno-occlusive disease).

Pulmonary Indications indications include Idiopathic Pulmonary Fibrosis, Silicosis, Pneumoconiosis, Bronchopulmonary Dysplasia in newborn following neonatal respiratory distress syndrome, Bleomycin/chemo lung injury, Brochiolitis Obliterans (BOS) post lung transplant, Chronic obstructive pulmonary disorder (COPD), Cystic Fibrosis, Asthma.

Cardiac indications include Cardiomyopathy, Atherosclerosis (Bergers disease, etc), Endomyocardial fibrosis, Atrial Fibrillation, Scarring post Myocardial Infarction (MI)

Other Thoracic indications include Radiation-induced capsule tissue reactions around textured breast implants and Oral submucosal fibrosis.

Renal indications include Autosomal Dominant Polycystic Kidney Disease (ADPKD), Diabetic nephropathy (diabetic glomerulosclerosis), FSGS (collapsing vs, other histologic variants), IgA Nephropathy (Berger Disease), Lupus Nephritis, Wegner's, Scleroderma, Goodpasture Syndrome, tubulointerstitial fibrosis: drug induced (protective) pencillins, cephalosporins, analgesic nephropathy, Membranoproliferative glomerulonephritis (MPGN), Henoch-Schonlein Purpura, Congenital nephropathies: Medullary Cystic Disease, Nail-Patella Syndrome and Alport Syndrome.

Bone Marrow indications include lympangiolyomyositosis (LAM), Chronic graft vs. host disease, Polycythemia vera, Essential thrombocythemia, Myelofibrosis.

Ocular indications include Retinopathy of Prematurity (RoP), Ocular cicatricial pemphigoid, Lacrimal gland fibrosis, Retinal attachment surgery, Corneal opacity, Herpetic keratitis, Pterygia, Glaucoma, Age-related macular degeneration (AMD/ARMD), Retinal fibrosis associated Diabetes mellitus (DM) retinopathy Gynecological indications include Endometriosis add on to hormonal therapy for prevention of scarring, post STD fibrosis/salphingitis, Systemic indications include Dupuytren's disease, palmar fibromatosis, Peyronie's disease, Ledderhose disease, keloids, multifocal fibrosclerosis, nephrogenic systemic fibrosis, nephrogenic myelofibrosis (anemia).

Injury Associated Fibrotic Diseases include Burn (chemical included) induced skin & soft tissue scarring and contraction, Radiation induce skin & organ scarring post cancer therapeutic radiation treatment, Keloid (skin).

Surgical indications include peritoneal fibrosis post peritoneal dialysis catheter, corneal implant, cochlear implant, other implants, silicone implants in breasts, chronic sinusitis; adhesions, pseudointimal hyperplasia of dialysis grafts.

Other indications include Chronic Pancreatitis.

In some embodiments provided is a method for treatment of a subject suffering from liver fibrosis comprising administering to the subject an effective amount of a nucleic acid molecule disclosed herein, thereby treating liver fibrosis. In some embodiments the subject is suffering from cirrhosis of the liver due to hepatitis. In some embodiments the subject is suffering from cirrhosis of the liver due to NASH.

In some embodiments provided is the use of a nucleic acid molecule disclosed herein for the manufacture of a medicament to treat liver fibrosis. In some embodiments the liver fibrosis is due to hepatitis. In some embodiments the liver fibrosis is due to NASH.

In some embodiments provided is a method for remodeling of scar tissue comprising administering to a subject in need thereof an effective amount of a nucleic acid molecule disclosed herein, thereby effecting scar tissue remodeling. In some embodiments the scar tissue is in the liver. In some embodiments the subject is suffering from cirrhosis of the liver due to hepatitis. In some embodiments the subject is suffering from cirrhosis of the liver due to NASH.

In some embodiments provided is a method for effecting fibrosis regression comprising administering to a subject in need thereof an effective amount of a nucleic acid molecule disclosed herein, thereby effecting fibrosis regression.

In some embodiments provided is a method for reduction of scar tissue in a subject comprising the step of administering to the subject an effective amount of a nucleic acid molecule disclosed herein to reduce the scar tissue. In some embodiments provided is a method for reducing scar tissue in a subject comprising the step of topically applying to scar tissue an effective amount of a nucleic acid molecule disclosed herein to reduce scar tissue.

In some embodiments provided is a method for improving the appearance of scar tissue comprising the step of topically applying to scar tissue an effective amount of a nucleic acid molecule disclosed herein to improve the appearance of the scar tissue.

In some embodiments provided is a method for treatment of a subject suffering from lung fibrosis comprising administering to the subject an effective amount of a nucleic acid molecule disclosed herein, thereby treating the lung fibrosis. In some embodiments the subject is suffering from interstitial lung fibrosis (ILF). In some embodiments the subject is suffering from Radiation Pneumonitis leading to Pulmonary Fibrosis. In some embodiments the subject is suffering from drug induced lung fibrosis.

In some embodiments provided is the use of a nucleic acid molecule disclosed herein for the manufacture of a medicament to treat lung fibrosis. In some embodiments the lung fibrosis is ILF. In some embodiments the lung fibrosis drug- or radiatio-induced lung fibrosis.

In one aspect, provided are pharmaceutical compositions that include a nucleic acid molecule (e.g., an siNA molecule) as described herein in a pharmaceutically acceptable carrier. In certain embodiments, the pharmaceutical formulation includes, or involves, a delivery system suitable for delivering nucleic acid molecules (e.g., siNA molecules) to an individual such as a patient; for example delivery systems described in more detail below.

In a related aspect, provided are compositions or kits that include a nucleic acid molecule (e.g., an siNA molecule) packaged for use by a patient. The package may be labeled or include a package label or insert that indicates the content of the package and provides certain information regarding how the nucleic acid molecule (e.g., an siNA molecule) should be or can be used by a patient, for example the label may include dosing information and/or indications for use. In certain embodiments the contents of the label will bear a notice in a form prescribed by a government agency, for example the United States Food and Drug administration. In certain embodiments, the label may indicate that the nucleic acid molecule (e.g., an siNA molecule) is suitable for use in treating a patient suffering from a disease associated with hsp47; for example, the label may indicate that the nucleic acid molecule (e.g., an siNA molecule) is suitable for use in treating fibroids; or for example the label may indicate that the nucleic acid molecule (e.g., an siNA molecule) is suitable for use in treating a disease selected from the group consisting of fibrosis, liver fibrosis, cirrhosis, pulmonary fibrosis, kidney fibrosis, peritoneal fibrosis, chronic hepatic damage, and fibrillogenesis, As used herein, the term "heat shock protein 47" or "hsp47" or "HSP47" are used interchangeably and refer to any heat shock protein 47, peptide, or polypeptide having any hsp47 protein activity. Heat shock protein 47 is a serine proteinase inhibitor (serpin) also known, for example, as serpin peptidase inhibitor, Glade H, member 1 (SERPINH1), SERPINH2, collagen binding protein 1 (CBP1), CBP2, gp46; arsenic-transactivated protein 3 (AsTP3); HSP47; proliferation-inducing gene 14 (PIG14); PPROM; rheumatoid arthritis antigen A-47 (RA-A47); colligin-1; and colligin-2. In certain preferred embodiments, "hsp47" refers to human hsp47. Heat shock protein 47 (or more particularly human hsp47) may have an amino acid sequence that is the same, or substantially the same, as SEQ ID NO. 2 (FIG. 7).

As used herein the term "nucleotide sequence encoding hsp47" means a nucleotide sequence that codes for an hsp47 protein or portion thereof. The term "nucleotide sequence encoding hsp47" is also meant to include hsp47 coding sequences such as hsp47 isoforms, mutant hsp47 genes, splice variants of hsp47 genes, and hsp47 gene polymorphisms. A nucleic acid sequence encoding hsp47 includes mRNA sequences encoding hsp47, which can also be referred to as "hsp47 mRNA." An exemplary sequence of human hsp47 mRNA is SEQ ID. NO. 1.

As used herein, the term "nucleic acid molecule" or "nucleic acid" are used interchangeably and refer to an oligonucleotide, nucleotide or polynucleotide. Variations of "nucleic acid molecule" are described in more detail herein. A nucleic acid molecule encompasses both modified nucleic acid molecules and unmodified nucleic acid molecules as described herein. A nucleic acid molecule may include deoxyribonucleotides, ribonucleotides, modified nucleotides or nucleotide analogs in any combination.

As used herein, the term "nucleotide" refers to a chemical moiety having a sugar (or an analog thereof, or a modified sugar), a nucleotide base (or an analog thereof, or a modified base), and a phosphate group (or analog thereof, or a modified phosphate group). A nucleotide encompasses both modified nucleotides or unmodified nucleotides as described herein. As used herein, nucleotides may include deoxyribonucleotides (e.g., unmodified deoxyribonucleotides), ribonucleotides (e.g., unmodified ribonucleotides), and modified nucleotide analogs including, inter alia, locked nucleic acids and unlocked nucleic acids, peptide nucleic acids, L-nucleotides (also referred to as mirror nucleotides), ethylene-bridged nucleic acid (ENA), arabinoside, PACE, nucleotides with a 6 carbon sugar, as well as nucleotide analogs (including abasic nucleotides) often considered to be non-nucleotides. In some embodiments, nucleotides may be modified in the sugar, nucleotide base and/or in the phosphate group with any modification known in the art, such as modifications described herein. A "polynucleotide" or "oligonucleotide" as used herein refer to a chain of linked nucleotides; polynucleotides and oligonucleotides may likewise have modifications in the nucleotide sugar, nucleotide bases and phosphate backbones as are well known in the art and/or are disclosed herein.

As used herein, the term "short interfering nucleic acid", "siNA", or "short interfering nucleic acid molecule" refers to any nucleic acid molecule capable of modulating gene expression or viral replication. Preferably siNA inhibits or down regulates gene expression or viral replication. siNA includes without limitation nucleic acid molecules that are capable of mediating sequence specific RNAi, for example short interfering RNA (siRNA), double-stranded RNA (dsRNA), micro-RNA (miRNA), short hairpin RNA (shRNA), short interfering oligonucleotide, short interfering nucleic acid, short interfering modified oligonucleotide, chemically-modified siRNA, post-transcriptional gene silencing RNA (ptgsRNA), and others. As used herein, "short interfering nucleic acid", "siNA", or "short interfering nucleic acid molecule" has the meaning described in more detail elsewhere herein.

As used herein, the term "complementary" means that a nucleic acid can form hydrogen bond(s) with another nucleic acid sequence by either traditional Watson-Crick or other non-traditional types. In reference to the nucleic molecules disclosed herein, the binding free energy for a nucleic acid molecule with its complementary sequence is sufficient to allow the relevant function of the nucleic acid to proceed, e.g., RNAi activity. Determination of binding free energies for nucleic acid molecules is well known in the art (see, e.g., Turner et al., 1987, CSH Symp. Quant. Biol. LII pp. 123-133; Frier et al., 1986, Proc. Nat. Acad. Sci. USA 83:9373-9377; Turner et al., 1987, J. Am. Chem. Soc. 109:3783-3785). A percent complementarity indicates the percentage of contiguous residues in a nucleic acid molecule that can form hydrogen bonds (e.g., Watson-Crick base pairing) with a second nucleic acid sequence (e.g., 5, 6, 7, 8, 9, or 10 nucleotides out of a total of 10 nucleotides in the first oligonucleotide being based paired to a second nucleic acid sequence having 10 nucleotides represents 50%, 60%, 70%, 80%, 90%, and 100% complementary respectively). "Fully complementary" means that all the contiguous residues of a nucleic acid sequence will hydrogen bond with the same number of contiguous residues in a second nucleic acid sequence. In one embodiment, a nucleic acid molecule disclosed herein includes about 15 to about 35 or more (e.g., about 15, 16, 17, 18, 19, 20, 21, 22, 23, 24, 25, 26, 27, 28, 29, 30, 31, 32, 33, 34 or 35 or more) nucleotides that are complementary to one or more target nucleic acid molecules or a portion thereof.

As used herein, the term "sense region" refers to a nucleotide sequence of a siNA molecule complementary (partially or fully) to an antisense region of the siNA molecule. The sense strand of a siNA molecule can include a nucleic acid sequence having homology with a target nucleic acid sequence. As used herein, "sense strand" refers to nucleic acid molecule that includes a sense region and may also include additional nucleotides.

As used herein, the term "antisense region" refers to a nucleotide sequence of a siNA molecule complementary (partially or fully) to a target nucleic acid sequence. The antisense strand of a siNA molecule can optionally include a nucleic acid sequence complementary to a sense region of the siNA molecule. As used herein, "antisense strand" refers to nucleic acid molecule that includes an antisense region and may also include additional nucleotides.

As used herein, the term "RNA" refers to a molecule that includes at least one ribonucleotide residue.

As used herein, the term "duplex region" refers to the region in two complementary or substantially complementary oligonucleotides that form base pairs with one another, either by Watson-Crick base pairing or any other manner that allows for a duplex between oligonucleotide strands that are complementary or substantially complementary. For example, an oligonucleotide strand having 21 nucleotide units can base pair with another oligonucleotide of 21 nucleotide units, yet only 19 bases on each strand are complementary or substantially complementary, such that the "duplex region" consists of 19 base pairs. The remaining base pairs may, for example, exist as 5' and 3' overhangs. Further, within the duplex region, 100% complementarity is not required; substantial complementarity is allowable within a duplex region. Substantial complementarity refers to complementarity between the strands such that they are capable of annealing under biological conditions. Techniques to empirically determine if two strands are capable of annealing under biological conditions are well know in the art. Alternatively, two strands can be synthesized and added together under biological conditions to determine if they anneal to one another.

As used herein, the terms "non-pairing nucleotide analog" means a nucleotide analog which includes a non-base pairing moiety including but not limited to: 6 des amino adenosine (Nebularine), 4-Me-indole, 3-nitropyrrole, 5-nitroindole, Ds, Pa, N3-Me ribo U, N3-Me riboT, N3-Me dC, N3-Me-dT, N1-Me-dG, N1-Me-dA, N3-ethyl-dC, N3-Me dC. In some embodiments the non-base pairing nucleotide analog is a ribonucleotide. In other embodiments it is a deoxyribonucleotide.

As used herein, the term, "terminal functional group" includes without limitation a halogen, alcohol, amine, carboxylic, ester, amide, aldehyde, ketone, ether groups.

An "abasic nucleotide" or "abasic nucleotide analog" is as used herein may also be often referred to herein and in the art as a pseudo-nucleotide or an unconventional moiety. While a nucleotide is a monomeric unit of nucleic acid, generally consisting of a ribose or deoxyribose sugar, a phosphate, and a base (adenine, guanine, thymine, or cytosine in DNA; adenine, guanine, uracil, or cytosine in RNA), an abasic or pseudo-nucleotide lacks a base, and thus is not strictly a nucleotide as the term is generally used in the art. Abasic deoxyribose moieties include for example, abasic deoxyribose-3'-phosphate; 1,2-dideoxy-D-ribofuranose-3-phosphate; 1,4-anhydro-2-deoxy-D-ribitol-3-phosphate. Inverted abasic deoxyribose moieties include inverted deoxyriboabasic; 3',5' inverted deoxyabasic 5'-phosphate.

The term "capping moiety" (z") as used herein includes a moiety which can be covalently linked to the 5' terminus of (N')y and includes abasic ribose moiety, abasic deoxyribose moiety, modifications abasic ribose and abasic deoxyribose moieties including 2'O alkyl modifications; inverted abasic ribose and abasic deoxyribose moieties and modifications thereof; C6-imino-Pi; a mirror nucleotide including L-DNA and L-RNA; 5'OMe nucleotide; and nucleotide analogs including 4',5'-methylene nucleotide; 1-(β-D-erythrofuranosyl)nucleotide; 4'-thio nucleotide, carbocyclic nucleotide; 5'-amino-alkyl phosphate; 1,3-diamino-2-propyl phosphate, 3-aminopropyl phosphate; 6-aminohexyl phosphate; 12-aminododecyl phosphate; hydroxypropyl phosphate; 1,5-anhydrohexitol nucleotide; alpha-nucleotide; threo-pentofuranosyl nucleotide; acyclic 3',4'-seco nucleotide; 3,4-dihydroxybutyl nucleotide; 3,5-dihydroxypentyl nucleotide, 5'-5'-inverted abasic moiety; 1,4-butanediol phosphate; 5'-amino; and bridging or non bridging methylphosphonate and 5'-mercapto moieties.

Certain capping moieties may be abasic ribose or abasic deoxyribose moieties; inverted abasic ribose or abasic deoxyribose moieties; C6-amino-Pi; a mirror nucleotide including L-DNA and L-RNA. The nucleic acid molecules as disclosed herein may be synthesized using one or more inverted nucleotides, for example inverted thymidine or inverted adenine (for example see Takei, et al., 2002. JBC 277 (26)23800-06).

The term "unconventional moiety" as used herein refers to non-nucleotide moieties including an abasic moiety, an inverted abasic moiety, a hydrocarbon (alkyl) moiety and derivatives thereof, and further includes a deoxyribonucleotide, a modified deoxyribonucleotide, a mirror nucleotide (L-DNA or L-RNA), a non-base pairing nucleotide analog and a nucleotide joined to an adjacent nucleotide by a 2'-5' internucleotide phosphate bond; bridged nucleic acids including LNA and ethylene bridged nucleic acids, linkage modified (e.g. PACE) and base modified nucleotides as well as additional moieties explicitly disclosed herein as unconventional moieties.

As used herein, the term "inhibit", "down-regulate", or "reduce" with respect to gene expression means the expression of the gene, or level of RNA molecules or equivalent RNA molecules encoding one or more proteins or protein subunits (e.g., mRNA), or activity of one or more proteins or protein subunits, is reduced below that observed in the absence of an inhibitory factor (such as a nucleic acid molecule, e.g., an siNA, for example having structural features as described herein); for example the expression may be reduced to 90%, 80%, 70%, 60%, 50%, 40%, 30%, 20%, 10%, 5% or less than that observed in the absence of an inhibitor.

BRIEF DESCRIPTION OF THE FIGURES

FIG. 6 is an exemplary nucleic acid sequence of human hsp47 mRNA cDNA (SEQ ID NO: 1; based on the cDNA disclosed in GenBank accession number: NM 001235).

FIG. 7 is an exemplary amino acid sequence of human hsp47 (SEQ ID NO:2).

FIG. 8 is protein coding nucleic acid sequence of human hsp47 cDNA (SEQ ID NO:59), which corresponds to nucleotides 230-1486 of SEQ ID NO: 1.

DETAILED DESCRIPTION OF THE INVENTION

Figure 1:
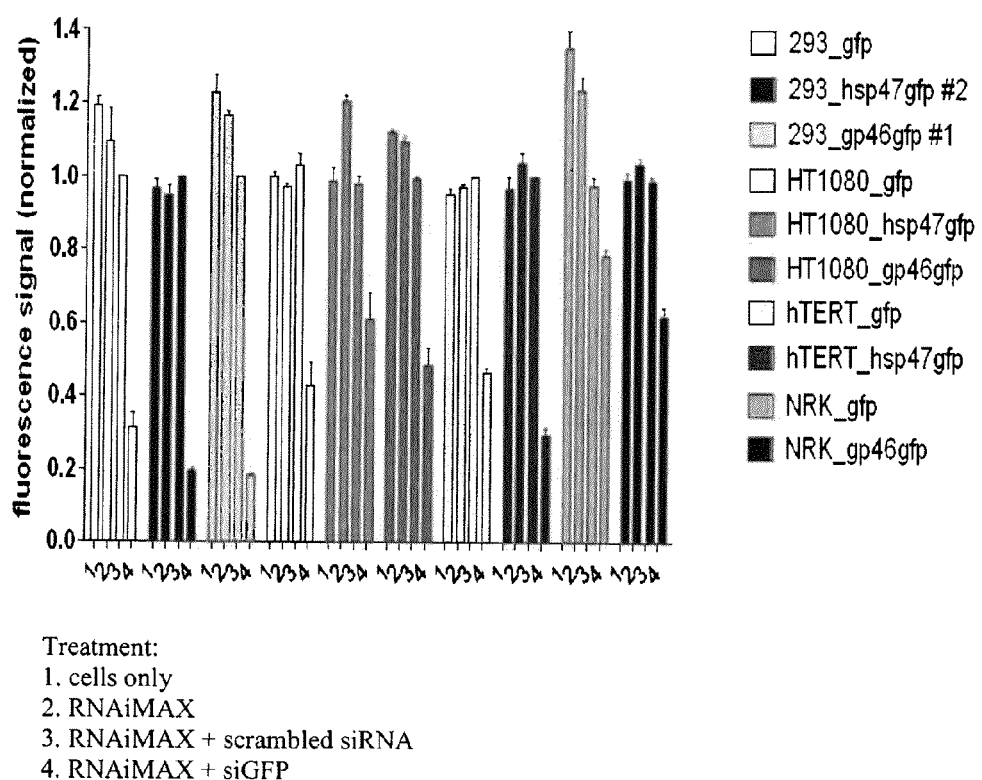
FIG. 1 is a bar graph showing the effect of GFP siNA on various reporter cell lines. Cell lines were established by lenti-viral induction of human HSP47 cDNA-GFP or rat GP46 cDNA-GFP construct into HEK293, human fibrosarcoma cell line HT1080, human HSC line hTERT or NRK cell line. Negative control siNA or siNA against GFP was introduced into the cells and GFP fluorescence was measured. The results showed that siNA against GFP knocks down the fluorescence to different extent in different cell lines. 293 HSP47-GFP and 293_GP46-GFP cell lines were selected for siHsp47 screening due to their easiness of being transfected and sensitivity to fluorescence knockdown.

RNA Interference and siNA Nucleic Acid Molecules

RNA interference refers to the process of sequence-specific post-transcriptional gene silencing in animals mediated by short interfering RNAs (siRNAs) (Zamore et al., 2000, Cell, 101, 25-33; Fire et al., 1998, Nature, 391, 806; Hamilton et al., 1999, Science, 286, 950-951; Lin et al., 1999, Nature, 402, 128-129; Sharp, 1999, Genes & Dev., 13:139-141; and Strauss, 1999, Science, 286, 886). The corresponding process in plants (Heifetz et al., International PCT Publication No. WO 99/61631) is often referred to as post-transcriptional gene silencing (PTGS) or RNA silencing. The process of post-transcriptional gene silencing is thought to be an evolutionarily-conserved cellular defense mechanism used to prevent the expression of foreign genes (Fire et al., 1999, Trends Genet., 15, 358). Such protection from foreign gene expression may have evolved in response to the production of double-stranded RNAs (dsRNAs) derived from viral infection or from the random integration of transposon elements into a host genome via a cellular response that specifically destroys homologous single-stranded RNA or viral genomic RNA. The presence of dsRNA in cells triggers the RNAi response through a mechanism that has yet to be fully characterized. This mechanism appears to be different from other known mechanisms involving double stranded RNA-specific ribonucleases, such as the interferon response that results from dsRNA-mediated activation of protein kinase PKR and 2',5'-oligoadenylate synthetase resulting in non-specific cleavage of mRNA by ribonuclease L (see for example U.S. Pat. Nos. 6,107,094; 5,898,031; Clemens et al., 1997, J. Interferon & Cytokine Res., 17, 503-524; Adah et al., 2001, Curr. Med. Chem., 8, 1189).

The presence of long dsRNAs in cells stimulates the activity of a ribonuclease III enzyme referred to as dicer (Bass, 2000, Cell, 101, 235; Zamore et al., 2000, Cell, 101, 25-33;

Hammond et al., 2000, Nature, 404, 293). Dicer is involved in the processing of the dsRNA into short pieces of dsRNA known as short interfering RNAs (siRNAs) (Zamore et al., 2000, Cell, 101, 25-33; Bass, 2000, Cell, 101, 235; Berstein et al., 2001, Nature, 409, 363). Short interfering RNAs derived from dicer activity are typically about 21 to about 23 nucleotides in length and include about 19 base pair duplexes (Zamore et al., 2000, Cell, 101, 25-33; Elbashir et al., 2001, Genes Dev., 15, 188). Dicer has also been implicated in the excision of 21- and 22-nucleotide small temporal RNAs (stRNAs) from precursor RNA of conserved structure that are implicated in translational control (Hutvagner et al., 2001, Science, 293, 834). The RNAi response also features an endonuclease complex, commonly referred to as an RNA-induced silencing complex (RISC), which mediates cleavage of single-stranded RNA having sequence complementary to the antisense strand of the si RNA duplex. Cleavage of the target RNA takes place in the middle of the region complementary to the antisense strand of the siRNA duplex (Elbashir et al., 2001, Genes Dev., 15, 188).

RNAi has been studied in a variety of systems. Fire et al., 1998, Nature, 391, 806, were the first to observe RNAi in *C. elegans*. Bahramian and Zarbl, 1999, Molecular and Cellular Biology, 19, 274-283 and Wianny and Goetz, 1999, Nature Cell Biol., 2, 70, describe RNAi mediated by dsRNA in mammalian systems. Hammond et al., 2000, Nature, 404, 293, describe RNAi in *Drosophila* cells transfected with dsRNA. Elbashir et al., 2001, Nature, 411, 494 and Tuschl et al., International PCT Publication No. WO 01/75164, describe RNAi induced by introduction of duplexes of synthetic 21-nucleotide RNAs in cultured mammalian cells including human embryonic kidney and HeLa cells. Recent work in *Drosophila* embryonic lysates (Elbashir et al., 2001, EMBO J., 20, 6877 and Tuschl et al., International PCT Publication No. WO 01/75164) has revealed certain requirements for siRNA length, structure, chemical composition, and sequence that are essential to mediate efficient RNAi activity.

Nucleic acid molecules (for example having structural features as disclosed herein) may inhibit or down regulate gene expression or viral replication by mediating RNA interference "RNAi" or gene silencing in a sequence-specific manner; see e.g., Zamore et al., 2000, Cell, 101, 25-33; Bass, 2001, Nature, 411, 428-429; Elbashir et al., 2001, Nature, 411, 494-498; and Kreutzer et al., International PCT Publication No. WO 00/44895; Zernicka-Goetz et al., International PCT Publication No. WO 01/36646; Fire, International PCT Publication No. WO 99/32619; Plaetinck et al., International PCT Publication No. WO 00/01846; Mello and Fire, International PCT Publication No. WO 01/29058; Deschamps-Depaillette, International PCT Publication No. WO 99/07409; and Li et al., International PCT Publication No. WO 00/44914; Allshire, 2002, Science, 297, 1818-1819; Volpe et al., 2002, Science, 297, 1833-1837; Jenuwein, 2002, Science, 297, 2215-2218; and Hall et al., 2002, Science, 297, 2232-2237; Hutvagner and Zamore, 2002, Science, 297, 2056-60; McManus et al., 2002, RNA, 8, 842-850; Reinhart et al., 2002, Gene & Dev., 16, 1616-1626; and Reinhart & Bartel, 2002, Science, 297, 1831).

An siNA nucleic acid molecule can be assembled from two separate polynucleotide strands, where one strand is the sense strand and the other is the antisense strand in which the antisense and sense strands are self-complementary (i.e. each strand includes nucleotide sequence that is complementary to nucleotide sequence in the other strand); such as where the antisense strand and sense strand form a duplex or double stranded structure having any length and structure as described herein for nucleic acid molecules as provided, for example wherein the double stranded region (duplex region) is about 15 to about 49 (e.g., about 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49 base pairs); the antisense strand includes nucleotide sequence that is complementary to nucleotide sequence in a target nucleic acid molecule (i.e., hsp47 mRNA) or a portion thereof and the sense strand includes nucleotide sequence corresponding to the target nucleic acid sequence or a portion thereof (e.g., about 17 to about 49 or more nucleotides of the nucleic acid molecules herein are complementary to the target nucleic acid or a portion thereof).

In certain aspects and embodiments a nucleic acid molecule (e.g., a siNA molecule) provided herein may be a "RISC length" molecule or may be a Dicer substrate as described in more detail below.

An siNA nucleic acid molecule may include separate sense and antisense sequences or regions, where the sense and antisense regions are covalently linked by nucleotide or non-nucleotide linkers molecules as is known in the art, or are alternately non-covalently linked by ionic interactions, hydrogen bonding, van der Waals interactions, hydrophobic interactions, and/or stacking interactions. Nucleic acid molecules may include a nucleotide sequence that is complementary to nucleotide sequence of a target gene. Nucleic acid molecules may interact with nucleotide sequence of a target gene in a manner that causes inhibition of expression of the target gene.

Alternatively, an siNA nucleic acid molecule is assembled from a single polynucleotide, where the self-complementary sense and antisense regions of the nucleic acid molecules are linked by means of a nucleic acid based or non-nucleic acid-based linker(s), i.e., the antisense strand and the sense strand are part of one single polynucleotide that having an antisense region and sense region that fold to form a duplex region (for example to form a "hairpin" structure as is well known in the art). Such siNA nucleic acid molecules can be a polynucleotide with a duplex, asymmetric duplex, hairpin or asymmetric hairpin secondary structure, having self-complementary sense and antisense regions, wherein the antisense region includes nucleotide sequence that is complementary to nucleotide sequence in a separate target nucleic acid molecule or a portion thereof and the sense region having nucleotide sequence corresponding to the target nucleic acid sequence (e.g., a sequence of hsp47 mRNA). Such siNA nucleic acid molecules can be a circular single-stranded polynucleotide having two or more loop structures and a stem comprising self-complementary sense and antisense regions, wherein the antisense region includes nucleotide sequence that is complementary to nucleotide sequence in a target nucleic acid molecule or a portion thereof and the sense region having nucleotide sequence corresponding to the target nucleic acid sequence or a portion thereof, and wherein the circular polynucleotide can be processed either in vivo or in vitro to generate an active nucleic acid molecule capable of mediating RNAi.

The following nomenclature is often used in the art to describe lengths and overhangs of siNA molecules and may be used throughout the specification and Examples. Names given to duplexes indicate the length of the oligomers and the presence or absence of overhangs. For example, a "21+2" duplex contains two nucleic acid strands both of which are 21 nucleotides in length, also termed a 21-mer siRNA duplex or a 21-mer nucleic acid and having a 2 nucleotides 3'-overhang. A "21−2" design refers to a 21-mer nucleic acid duplex with a 2 nucleotides 5'-overhang. A 21−0 design is a 21-mer nucleic acid duplex with no overhangs (blunt). A "21+2UU" is a 21-mer duplex with 2-nucleotides 3'-overhang and the terminal 2 nucleotides at the 3'-ends are both U residues (which may result in mismatch with target sequence). The aforementioned nomenclature can be applied to siNA molecules of various lengths of strands, duplexes and overhangs (such as 19–0, 21+2, 27+2, and the like). In an alternative but similar nomenclature, a "25/27" is an asymmetric duplex having a 25 base sense strand and a 27 base antisense strand with a 2-nucleotides 3'-overhang. A "27/25" is an asymmetric duplex having a 27 base sense strand and a 25 base antisense strand.

Chemical Modifications

In certain aspects and embodiments, nucleic acid molecules (e.g., siNA molecules) as provided herein include one or more modifications (or chemical modifications). In certain embodiments, such modifications include any changes to a nucleic acid molecule or polynucleotide that would make the molecule different than a standard ribonucleotide or RNA molecule (i.e., that includes standard adenosine, cytosine, uracil, or guanosine moieties); which may be referred to as an "unmodified" ribonucleotide or unmodified ribonucleic acid. Traditional DNA bases and polynucleotides having a 2'-deoxy sugar represented by adenosine, cytosine, thymine, or guanosine moieties may be referred to as an "unmodified deoxyribonucleotide" or "unmodified deoxyribonucleic acid"; accordingly, the term "unmodified nucleotide" or "unmodified nucleic acid" as used herein refers to an "unmodified ribonucleotide" or "unmodified ribonucleic acid" unless there is a clear indication to the contrary. Such modifications can be in the nucleotide sugar, nucleotide base, nucleotide phosphate group and/or the phosphate backbone of a polynucleotide.

In certain embodiments modifications as disclosed herein may be used to increase RNAi activity of a molecule and/or to increase the in vivo stability of the molecules, particularly the stability in serum, and/or to increase bioavailability of the molecules. Non-limiting examples of modifications include without limitation internucleotide or internucleoside linkages; deoxynucleotides or dideoxyribonucleotides at any position and strand of the nucleic acid molecule; nucleic acid (e.g., ribonucleic acid) with a modification at the 2'-position preferably selected from an amino, fluoro, methoxy, alkoxy and alkyl; 2'-deoxyribonucleotides, 2'-O-methyl ribonucleotides, 2'-deoxy-2'-fluoro ribonucleotides, "universal base" nucleotides, "acyclic" nucleotides, 5-C-methyl nucleotides, biotin group, and terminal glyceryl and/or inverted deoxy abasic residue incorporation, sterically hindered molecules, such as fluorescent molecules and the like. Other nucleotides modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). Further details on various modifications are described in more detail below.

Modified nucleotides include those having a Northern conformation (e.g., Northern pseudorotation cycle, see for example Saenger, Principles of Nucleic Acid Structure, Springer-Verlag ed., 1984). Non-limiting examples of nucleotides having a northern configuration include locked nucleic acid (LNA) nucleotides (e.g., 2'-O, 4'-C-methylene-(D-ribofuranosyl) nucleotides); 2'-methoxyethoxy (MOE) nucleotides; 2'-methyl-thio-ethyl, 2'-deoxy-2'-fluoro nucleotides, 2'-deoxy-2'-chloro nucleotides, 2'-azido nucleotides, and 2'-O-methyl nucleotides. Locked nucleic acids, or LNA's are described, for example, in Elman et al., 2005; Kurreck et al., 2002; Crinelli et al., 2002; Braasch and Corey, 2001; Bondensgaard et al., 2000; Wahlestedt et al., 2000; and International Patent Publication Nos. WO 00/47599, WO 99/14226, and WO 98/39352 and WO 2004/083430. In one embodiment, an LNA is incorporated at the 5' terminus of the sense strand.

Chemical modifications also include unlocked nucleic acids, or UNAs, which are non-nucleotide, acyclic analogues, in which the C2'-C3' bond is not present (although UNAs are not truly nucleotides, they are expressly included in the scope of "modified" nucleotides or modified nucleic acids as contemplated herein). In particular embodiments, nucleic acid molecules with an overhang may be modified to have UNAs at the overhang positions (i.e., 2 nucleotide overhand). In other embodiments, UNAs are included at the 3'- or 5'-ends. A UNA may be located anywhere along a nucleic acid strand, i.e. in position 7. Nucleic acid molecules may contain one or more than UNA. Exemplary UNAs are disclosed in Nucleic Acids Symposium Series No. 52 p. 133-134 (2008). In certain embodiments a nucleic acid molecule (e.g., a siNA molecule) as described herein include one or more UNAs; or one UNA. In some embodiments, a nucleic acid molecule (e.g., a siNA molecule) as described herein that has a 3'-overhang include one or two UNAs in the 3' overhang. In some embodiments a nucleic acid molecule (e.g., a siNA molecule) as described herein includes a UNA (for example one UNA) in the antisense strand; for example in position 6 or position 7 of the antisense strand. Chemical modifications also include non-pairing nucleotide analogs, for example as disclosed herein. Chemical modifications further include unconventional moieties as disclosed herein.

Chemical modifications also include terminal modifications on the 5' and/or 3' part of the oligonucleotides and are also known as capping moieties. Such terminal modifications are selected from a nucleotide, a modified nucleotide, a lipid, a peptide, and a sugar.

Chemical modifications also include six membered "six membered ring nucleotide analogs." Examples of six-membered ring nucleotide analogs are disclosed in Allart, et al (Nucleosides & Nucleotides, 1998, 17:1523-1526; and Perez-Perez, et al., 1996, Bioorg. and Medicinal Chem Letters 6:1457-1460) Oligonucleotides including 6-membered ring nucleotide analogs including hexitol and altritol nucleotide monomers are disclosed in International patent application publication No. WO 2006/047842.

Chemical modifications also include "mirror" nucleotides which have a reversed chirality as compared to normal naturally occurring nucleotide; that is a mirror nucleotide may be an "L-nucleotide" analogue of naturally occurring D-nucleotide (see U.S. Pat. No. 6,602,858). Mirror nucleotides may further include at least one sugar or base modification and/or a backbone modification, for example, as described herein, such as a phosphorothioate or phosphonate moiety. U.S. Pat. No. 6,602,858 discloses nucleic acid catalysts including at least one L-nucleotide substitution. Mirror nucleotides include for example L-DNA (L-deoxyriboadenosine-3'-phosphate (mirror dA); L-deoxyribocytidine-3'-phosphate (mirror dC); L-deoxyriboguanosine-3'-phosphate (mirror dG); L-deoxyribothymidine-3'-phosphate (mirror image dT)) and L-RNA (L-riboadenosine-3'-phosphate (mirror rA); L-ribocytidine-3-phosphate (mirror rC); L-riboguanosine-3'-phosphate (mirror rG); L-ribouracil-3'-phosphate (mirror dU).

In some embodiments, modified ribonucleotides include modified deoxyribonucleotides, for example 5'OMe DNA (5-methyl-deoxyriboguanosine-3'-phosphate) which may be useful as a nucleotide in the 5' terminal position (position number 1); PACE (deoxyriboadenosine 3' phosphonoacetate, deoxyribocytidine 3' phosphonoacetate, deoxyriboguanosine 3' phosphonoacetate, deoxyribothymidine 3' phosphonoacetate.

Modifications may be present in one or more strands of a nucleic acid molecule disclosed herein, e.g., in the sense strand, the antisense strand, or both strands. In certain embodiments, the antisense strand may include modifications and the sense strand my only include unmodified RNA.

Nucleobases

Nucleobases of the nucleic acid disclosed herein may include unmodified ribonucleotides (purines and pyrimidines) such as adenine, guanine, cytosine, uracil. The nucleobases in one or both strands can be modified with natural and synthetic nucleobases such as, thymine, xanthine, hypoxanthine, inosine, 2-aminoadenine, 6-methyl and other alkyl derivatives of adenine and guanine, any "universal base" nucleotides; 2-propyl and other alkyl derivatives of adenine and guanine, 5-halouracil and cytosine, 5-propynyl uracil and cytosine, 6-azo uracil, cytosine and thymine, 5-uracil (pseudouracil), 4-thiouracil, 8-halo, amino, thiol, thioalkyl, hydroxyl and other 8-substituted adenines and guanines, 5-trifluoromethyl and other 5-substituted uracils and cytosines, 7-methylguanine, deazapurines, heterocyclic substituted analogs of purines and pyrimidines, e.g., aminoethyoxy phenoxazine, derivatives of purines and pyrimidines (e.g., 1-alkyl-, 1-alkenyl-, heteroaromatic- and 1-alkynyl derivatives) and tautomers thereof, 8-oxo-N-6-methyladenine, 7-diazaxanthine, 5-methylcytosine, 5-methyluracil, 5-(1-propynyl)uracil, 5-(1-propynyl) cytosine and 4,4-ethanocytosine). Other examples of suitable bases include nonpurinyl and non-pyrimidinyl bases such as 2-aminopyridine and triazines.

Sugar Moieties

Sugar moieties in nucleic acid disclosed herein may include 2'-hydroxyl-pentofuranosyl sugar moiety without any modification. Alternatively, sugar moieties can be modified such as, 2'-deoxy-pentofuranosyl sugar moiety, D-ribose, hexose, modification at the 2' position of the pentofuranosyl sugar moiety such as 2'-O-alkyl (including 2'-O-methyl and 2'-O-ethyl), i.e., 2'-alkoxy, 2'-amino, 2'-O-allyl, 2'-S-alkyl, 2'-halogen (including 2'-fluoro, chloro, and bromo), 2'-methoxyethoxy, 2'-O-methoxyethyl, 2'-O-2-methoxyethyl, 2'-allyloxy (—OCH2CH=CH2), 2'-propargyl, 2'-propyl, ethynyl, ethenyl, propenyl, CF, cyano, imidazole, carboxylate, thioate, C1 to C10 lower alkyl, substituted lower alkyl, alkaryl or aralkyl, OCF3, OCN, O-, S-, or N-alkyl; O-, S, or N-alkenyl; SOCH3; SO2CH3; ONO2; NO2, N3; heterozycloalkyl; heterozycloalkaryl; aminoalkylamino; polyalkylamino or substituted silyl, as, among others, for example as described in European patents EP 0 586 520 B1 or EP 0 618 925 B1.

Alkyl group includes saturated aliphatic groups, including straight-chain alkyl groups (e.g., methyl, ethyl, propyl, butyl, pentyl, hexyl, heptyl, octyl, nonyl, decyl, etc.), branched-chain alkyl groups (isopropyl, tert-butyl, isobutyl, etc.), cycloalkyl(alicyclic) groups (cyclopropyl, cyclopentyl, cyclohexyl, cycloheptyl, cyclooctyl), alkyl substituted cycloalkyl groups, and cycloalkyl substituted alkyl groups. In certain embodiments, a straight chain or branched chain alkyl has 6 or fewer carbon atoms in its backbone (e.g., C1-C6 for straight chain, C3-C6 for branched chain), and more preferably 4 or fewer. Likewise, preferred cycloalkyls may have from 3-8 carbon atoms in their ring structure, and more preferably have 5 or 6 carbons in the ring structure. The term C1-C6 includes alkyl groups containing 1 to 6 carbon atoms.

The alkyl group can be substituted alkyl group such as alkyl moieties having substituents replacing a hydrogen on one or more carbons of the hydrocarbon backbone. Such substituents can include, for example, alkenyl, alkynyl, halogen, hydroxyl, alkylcarbonyloxy, arylcarbonyloxy, alkoxycarbonyloxy, aryloxycarbonyloxy, carboxylate, alkylcarbonyl, arylcarbonyl, alkoxycarbonyl, aminocarbonyl, alkylaminocarbonyl, dialkylaminocarbonyl, alkylthiocarbonyl, alkoxyl, phosphate, phosphonato, phosphinato, cyano, amino (including alkyl amino, dialkylamino, arylamino, diarylamino, and alkylarylamino), acylamino (including alkylcarbonylamino, arylcarbonylamino, carbamoyl and ureido), amidino, imino, sulfhydryl, alkylthio, arylthio, thiocarboxylate, sulfates, alkylsulfinyl, sulfonato, sulfamoyl, sulfonamido, nitro, trifluoromethyl, cyano, azido, heterocyclyl, alkylaryl, or an aromatic or heteroaromatic moiety.

Alkoxy group includes substituted and unsubstituted alkyl, alkenyl, and alkynyl groups covalently linked to an oxygen atom. Examples of alkoxy groups include methoxy, ethoxy, isopropyloxy, propoxy, butoxy, and pentoxy groups. Examples of substituted alkoxy groups include halogenated alkoxy groups. The alkoxy groups can be substituted with groups such as alkenyl, alkynyl, halogen, hydroxyl, alkylcarbonyloxy, arylcarbonyloxy, alkoxycarbonyloxy, aryloxycarbonyloxy, carboxylate, alkylcarbonyl, arylcarbonyl, alkoxycarbonyl, aminocarbonyl, alkylaminocarbonyl, dialkylaminocarbonyl, alkylthiocarbonyl, alkoxyl, phosphate, phosphonato, phosphinato, cyano, amino (including alkyl amino, dialkylamino, arylamino, diarylamino, and alkyl aryl amino), acylamino (including alkylcarbonylamino, arylcarbonylamino, carbamoyl and ureido), amidino, imino, sulfhydryl, alkylthio, arylthio, thiocarboxylate, sulfates, alkylsulfinyl, sulfonato, sulfamoyl, sulfonamido, nitro, trifluoromethyl, cyano, azido, heterocyclyl, alkylaryl, or an aromatic or heteroaromatic moieties. Examples of halogen substituted alkoxy groups include, but are not limited to, fluoromethoxy, difluoromethoxy, trifluoromethoxy, chloromethoxy, dichloromethoxy, trichloromethoxy, etc.

In some embodiments, the pentafuronosyl ring may be replaced with acyclic derivatives lacking the C2'-C3'-bond of the pentafuronosyl ring. For example, acyclonucleotides may substitute a 2-hydroxyethoxymethyl group for-the 2'-deoxyribofuranosyl sugar normally present in dNMPs.

Halogens include fluorine, bromine, chlorine, iodine.

Backbone

The nucleoside subunits of the nucleic acid disclosed herein may be linked to each other by phosphodiester bond. The phosphodiester bond may be optionally substituted with other linkages. For example, phosphorothioate, thiophosphate-D-ribose entities, triester, thioate, 2'-5' bridged backbone (may also be referred to as 5'-2' or 2'5' nucleotide or 2'5' ribonucleotide), PACE, 3'-(or -5')deoxy-3'-(or -5')thio-phosphorothioate, phosphorodithioate, phosphoroselenates, 3'-(or -5')deoxy phosphinates, borano phosphates, 3'-(or -5')deoxy-3'-(or 5'-)amino phosphoramidates, hydrogen phosphonates, phosphonates, borano phosphate esters, phosphoramidates, alkyl or aryl phosphonates and phosphotriester modifications such as alkylphosphotriesters, phosphotriester phosphorus linkages, 5'-ethoxyphosphodiester, P-alkyl oxyphosphotriester, methylphosphonate, and nonphosphorus containing linkages for example, carbonate, carbamate, silyl, sulfur, sulfonate, sulfonamide, formacetal, thioformacetyl, oxime, methyleneimino, methylenemethylimino, methylenehydrazo, methylenedimethylhydrazo and methyleneoxymethylimino linkages.

Nucleic acid molecules disclosed herein may include a peptide nucleic acid (PNA) backbone. The PNA backbone is includes repeating N-(2-aminoethyl)-glycine units linked by peptide bonds. The various bases such as purine, pyrimidine, natural and synthetic bases are linked to the backbone by methylene carbonyl bonds.

Terminal Phosphates

Modifications can be made at terminal phosphate groups. Non-limiting examples of different stabilization chemistries can be used, e.g., to stabilize the 3'-end of nucleic acid sequences, including (1) [3-3']-inverted deoxyribose; (2) deoxyribonucleotide; (3) [5'-3']-3'-deoxyribonucleotide; (4) [5'-3']-ribonucleotide; (5) [5'-3']-3'-O-methyl ribonucleotide; (6) 3'-glyceryl; (7) [3'-5']-3'-deoxyribonucleotide; (8) [3'-3']-deoxyribonucleotide; (9) [5'-2']-deoxyribonucleotide; and (10) [5-3']-dideoxyribonucleotide. In addition to unmodified backbone chemistries can be combined with one or more different backbone modifications described herein.

Exemplary chemically modified terminal phosphate groups include those shown below:

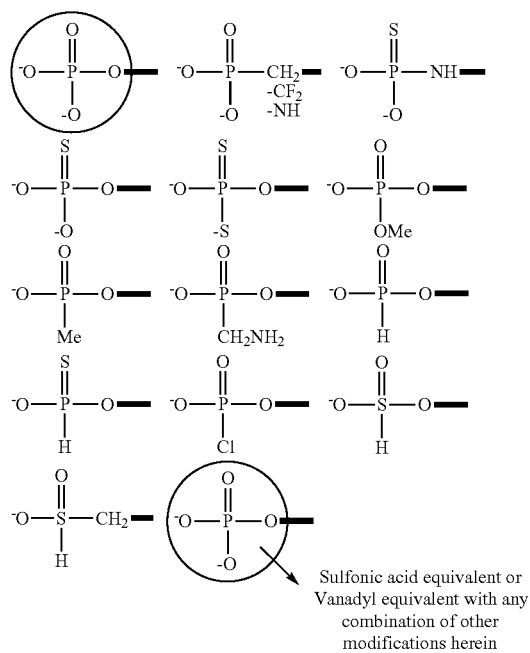

Sulfonic acid equivalent or Vanadyl equivalent with any combination of other modifications herein Conjugates Modified nucleotides and nucleic acid molecules (e.g., siNA molecules) as provided herein may include conjugates, for example, a conjugate covalently attached to the chemically-modified nucleic acid molecule. Non-limiting examples of conjugates include conjugates and ligands described in Vargeese et al., U.S. Ser. No. 10/427,160. The conjugate may be covalently attached to a nucleic acid molecule (such as an siNA molecule) via a biodegradable linker. The conjugate molecule may be attached at the 3'-end of either the sense strand, the antisense strand, or both strands of the chemically-modified nucleic acid molecule. The conjugate molecule may be attached at the 5'-end of either the sense strand, the antisense strand, or both strands of the chemically-modified nucleic acid molecule. The conjugate molecule may be attached both the 3'-end and 5'-end of either the sense strand, the antisense strand, or both strands of the chemically-modified nucleic acid molecule, or any combination thereof. In one embodiment, a conjugate molecule may include a molecule that facilitates delivery of a chemically-modified nucleic acid molecule into a biological system, such as a cell. In another embodiment, the conjugate molecule attached to the chemically-modified nucleic acid molecule is a polyethylene glycol, human serum albumin, or a ligand for a cellular receptor that can mediate cellular uptake. Examples of specific conjugate molecules contemplated by the instant invention that can be attached to chemically-modified nucleic acid molecules are described in Vargeese et al., U.S. Ser. No. 10/201,394.

Linkers

A nucleic acid molecule provided herein (e.g., an siNA) molecule may include a nucleotide, non-nucleotide, or mixed nucleotide/non-nucleotide linker that joins the sense region of the nucleic acid to the antisense region of the nucleic acid. A nucleotide linker can be a linker of ≥2 nucleotides in length, for example about 3, 4, 5, 6, 7, 8, 9, or 10 nucleotides in length. The nucleotide linker can be a nucleic acid aptamer. By "aptamer" or "nucleic acid aptamer" as used herein refers to a nucleic acid molecule that binds specifically to a target molecule wherein the nucleic acid molecule has sequence that includes a sequence recognized by the target molecule in its natural setting. Alternately, an aptamer can be a nucleic acid molecule that binds to a target molecule (such as hsp47 mRNA) where the target molecule does not naturally bind to a nucleic acid. For example, the aptamer can be used to bind to a ligand-binding domain of a protein, thereby preventing interaction of the naturally occurring ligand with the protein. This is a non-limiting example and those in the art will recognize that other embodiments can be readily generated using techniques generally known in the art. See e.g., Gold et al.; 1995, Annu. Rev. Biochem., 64, 763; Brody and Gold, 2000, J. Biotechnol., 74, 5; Sun, 2000, Curr. Opin. Mol. Ther., 2, 100; Kusser, 2000, J. Biotechnol., 74, 27; Hermann and Patel, 2000, Science, 287, 820; and Jayasena, 1999, Clinical Chemistry, 45, 1628.

A non-nucleotide linker may include an abasic nucleotide, polyether, polyamine, polyamide, peptide, carbohydrate, lipid, polyhydrocarbon, or other polymeric compounds (e.g. polyethylene glycols such as those having between 2 and 100 ethylene glycol units). Specific examples include those described by Seela and Kaiser, Nucleic Acids Res. 1990, 18:6353 and Nucleic Acids Res. 1987, 15:3113; Cload and Schepartz, J. Am. Chem. Soc. 1991, 113:6324; Richardson and Schepartz, J. Am. Chem. Soc. 1991, 113:5109; Ma et al., Nucleic Acids Res. 1993, 21:2585 and Biochemistry 1993, 32:1751; Durand et al., Nucleic Acids Res. 1990, 18:6353; McCurdy et al., Nucleosides & Nucleotides 1991, 10:287; Jschke et al., Tetrahedron Lett. 1993, 34:301; Ono et al., Biochemistry 1991, 30:9914; Arnold et al., International Publication No. WO 89/02439; Usman et al., International Publication No. WO 95/06731; Dudycz et al., International Publication No. WO 95/11910 and Ferentz and Verdine, J. Am. Chem. Soc. 1991, 113:4000.

5' Ends, 3' Ends and Overhangs

Nucleic acid molecules disclosed herein (e.g., siNA molecules) may be blunt-ended on both sides, have overhangs on both sides or a combination of blunt and overhang ends. Overhangs may occur on either the 5'- or 3'-end of the sense or antisense strand.

5'- and/or 3'-ends of double stranded nucleic acid molecules (e.g., siNA) may be blunt ended or have an overhang. The 5'-end may be blunt ended and the 3'-end has an overhang in either the sense strand or the antisense strand. In other embodiments, the 3'-end may be blunt ended and the 5'-end has an overhang in either the sense strand or the antisense strand. In yet other embodiments, both the 5'- and 3'-end are blunt ended or both the 5'- and 3'-ends have overhangs.

The 5'- and/or 3'-end of one or both strands of the nucleic acid may include a free hydroxyl group. The 5'- and/or 3'-end of any nucleic acid molecule strand may be modified to include a chemical modification. Such modification may stabilize nucleic acid molecules, e.g., the 3'-end may have increased stability due to the presence of the nucleic acid molecule modification. Examples of end modifications (e.g., terminal caps) include, but are not limited to, abasic, deoxy abasic, inverted (deoxy) abasic, glyceryl, dinucleotide, acyclic nucleotide, amino, fluoro, chloro, bromo, CN, CF, methoxy, imidazole, carboxylate, thioate, C1 to C10 lower alkyl, substituted lower alkyl, alkaryl or aralkyl, OCF3, OCN, O-, S-, or N-alkyl; O-, S-, or N-alkenyl; SOCH3; SO2CH3; ONO2; NO2, N3; heterocycloalkyl; heterocycloalkaryl; aminoalkylamino; polyalkylamino or substituted silyl, as, among others, described in European patents EP 586,520 and EP 618,925 and other modifications disclosed herein.

Nucleic acid molecules include those with blunt ends, i.e., ends that do not include any overhanging nucleotides. A nucleic acid molecule can include one or more blunt ends. The blunt ended nucleic acid molecule has a number of base pairs equal to the number of nucleotides present in each strand of the nucleic acid molecule. The nucleic acid molecule can include one blunt end, for example where the 5'-end of the antisense strand and the 3'-end of the sense strand do not have any overhanging nucleotides. Nucleic acid molecule may include one blunt end, for example where the 3'-end of the antisense strand and the 5'-end of the sense strand do not have any overhanging nucleotides. A nucleic acid molecule may include two blunt ends, for example where the 3'-end of the antisense strand and the 5'-end of the sense strand as well as the 5'-end of the antisense strand and 3'-end of the sense strand do not have any overhanging nucleotides. Other nucleotides present in a blunt ended nucleic acid molecule can include, for example, mismatches, bulges, loops, or wobble base pairs to modulate the activity of the nucleic acid molecule to mediate RNA interference.

In certain embodiments of the nucleic acid molecules (e.g., siNA molecules) provided herein, at least one end of the molecule has an overhang of at least one nucleotide (for example 1 to 8 overhang nucleotides). For example, one or both strands of a double stranded nucleic acid molecule disclosed herein may have an overhang at the 5'-end or at the 3'-end or both. An overhang may be present at either or both the sense strand and antisense strand of the nucleic acid molecule. The length of the overhang may be as little as one nucleotide and as long as 1 to 8 or more nucleotides (e.g., 1, 2, 3, 4, 5, 6, 7 or 8 nucleotides; in some preferred embodiments an overhang is 2, 3, 4, 5, 6, 7 or 8 nucleotides; for example an overhang may be 2 nucleotides. The nucleotide(s) forming the overhang may be include deoxyribonucleotide(s), ribonucleotide(s), natural and non-natural nucleobases or any nucleotide modified in the sugar, base or phosphate group such as disclosed herein. A double stranded nucleic acid molecule may have both 5'- and 3'-overhangs. The overhangs at the 5'- and 3'-end may be of different lengths. An overhang may include at least one nucleic acid modification which may be deoxyribonucleotide. One or more deoxyribonucleotides may be at the 5'-terminal. The 3'-end of the respective counter-strand of the nucleic acid molecule may not have an overhang, more preferably not a deoxyribonucleotide overhang. The one or more deoxyribonucleotide may be at the 3'-terminal. The 5'-end of the respective counter-strand of the dsRNA may not have an overhang, more preferably not a deoxyribonucleotide overhang. The overhang in either the 5'- or the 3'-end of a strand may be 1 to 8 (e.g., about 1, 2, 3, 4, 5, 6, 7 or 8) unpaired nucleotides, preferably, the overhang is 2-3 unpaired nucleotides; more preferably 2 unpaired nucleotides. Nucleic acid molecules may include duplex nucleic acid molecules with overhanging ends of about 1 to about 20 (e.g., about 1, 2, 3, 4, 5, 6, 7, 8, 9, 10, 11, 12, 13, 1, 15, 16, 17, 18, 19 or 20); preferably 1-8 (e.g., about 1, 2, 3, 4, 5, 6, 7 or 8) nucleotides, for example, about 21-nucleotide duplexes with about 19 base pairs and 3'-terminal mononucleotide, dinucleotide, or trinucleotide overhangs. Nucleic acid molecules herein may include duplex nucleic acid molecules with blunt ends, where both ends are blunt, or alternatively, where one of the ends is blunt. Nucleic acid molecules disclosed herein can include one or more blunt ends, i.e. where a blunt end does not have any overhanging nucleotides. In one embodiment, the blunt ended nucleic acid molecule has a number of base pairs equal to the number of nucleotides present in each strand of the nucleic acid molecule. The nucleic acid molecule may include one blunt end, for example where the 5'-end of the antisense strand and the 3'-end of the sense strand do not have any overhanging nucleotides. The nucleic acid molecule may include one blunt end, for example where the 3'-end of the antisense strand and the 5'-end of the sense strand do not have any overhanging nucleotides. A nucleic acid molecule may include two blunt ends, for example where the 3'-end of the antisense strand and the 5'-end of the sense strand as well as the 5'-end of the antisense strand and 3'-end of the sense strand do not have any overhanging nucleotides. In certain preferred embodiments the nucleic acid compounds are blunt ended. Other nucleotides present in a blunt ended siNA molecule can include, for example, mismatches, bulges, loops, or wobble base pairs to modulate the activity of the nucleic acid molecule to mediate RNA interference.

In many embodiments one or more, or all, of the overhang nucleotides of a nucleic acid molecule (e.g., a siNA molecule) as described herein includes are modified such as described herein; for example one or more, or all, of the nucleotides may be 2'-deoxynucleotides.

Amount, Location and Patterns of Modifications.

Nucleic acid molecules (e.g., siNA molecules) disclosed herein may include modified nucleotides as a percentage of the total number of nucleotides present in the nucleic acid molecule. As such, a nucleic acid molecule may include about 5% to about 100% modified nucleotides (e.g., about 5%, 10%, 15%, 20%, 25%, 30%, 35%, 40%, 45%, 50%, 55%, 60%, 65%, 70%, 75%, 80%, 85%, 90%, 95% or 100% modified nucleotides). The actual percentage of modified nucleotides present in a given nucleic acid molecule will depend on the total number of nucleotides present in the nucleic acid. If the nucleic acid molecule is single stranded, the percent modification can be based upon the total number of nucleotides present in the single stranded nucleic acid molecule. Likewise, if the nucleic acid molecule is double stranded, the percent modification can be based upon the total number of nucleotides present in the sense strand, antisense strand, or both the sense and antisense strands.

Nucleic acid molecules disclosed herein may include unmodified RNA as a percentage of the total nucleotides in the nucleic acid molecule. As such, a nucleic acid molecule may include about 5% to about 100% modified nucleotides (e.g., about 5%, 10%, 15%, 20%, 25%, 30%, 35%, 40%, 45%, 50%, 55%, 60%, 65%, 70%, 75%, 80%, 85%, 90%, 95% or 100% of total nucleotides present in a nucleic acid molecule.

A nucleic acid molecule (e.g., an siNA molecule) may include a sense strand that includes about 1 to about 5, specifically about 1, 2, 3, 4, or 5 phosphorothioate internucleotide linkages, and/or one or more (e.g., about 1, 2, 3, 4, 5, or more) 2'-deoxy, 2'-O-methyl, 2'-deoxy-2'-fluoro, and/or one or more (e.g., about 1, 2, 3, 4, 5, or more) universal base modified nucleotides, and optionally a terminal cap molecule at the 3-end, the 5'-end, or both of the 3'- and 5'-ends of the sense strand; and wherein the antisense strand includes about 1 to about 5 or more, specifically about 1, 2, 3, 4, 5, or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. A nucleic acid molecule may include about 1, 2, 3, 4, 5, 6, 7, 8, 9, 10, or more, pyrimidine nucleotides of the sense and/or antisense nucleic acid strand are chemically-modified with 2'-deoxy, 2'-O-methyl and/or 2'-deoxy-2'-fluoro nucleotides, with or without about 1 to about 5 or more, for example about 1, 2, 3, 4, 5, or more phosphorothioate internucleotide linkages and/or a terminal cap molecule at the 3'-end, the 5'-end, or both of the 3'- and 5'-ends, being present in the same or different strand.

A nucleic acid molecule may include about 1 to about 5 or more (specifically about 1, 2, 3, 4, 5 or more) phosphorothioate internucleotide linkages in each strand of the nucleic acid molecule.

A nucleic acid molecule may include 2'-5' internucleotide linkages, for example at the 3'-end, the 5'-end, or both of the 3'- and 5'-ends of one or both nucleic acid sequence strands. In addition, the 2'-5' internucleotide linkage(s) can be present at various other positions within one or both nucleic acid sequence strands, for example, about 1, 2, 3, 4, 5, 6, 7, 8, 9, 10, or more including every internucleotide linkage of a pyrimidine nucleotide in one or both strands of the siNA molecule can include a 2'-5' internucleotide linkage, or about 1, 2, 3, 4, 5, 6, 7, 8, 9, 10, or more including every internucleotide linkage of a purine nucleotide in one or both strands of the siNA molecule can include a 2'-5' internucleotide linkage.

A chemically-modified short interfering nucleic acid (siNA) molecule may include an antisense region, wherein any (e.g., one or more or all) pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any (e.g., one or more or all) purine nucleotides present in the antisense region are 2'-deoxy purine nucleotides (e.g., wherein all purine nucleotides are 2'-deoxy purine nucleotides or alternately a plurality of purine nucleotides are 2'-deoxy purine nucleotides).

A chemically-modified short interfering nucleic acid (siNA) molecule may include an antisense region, wherein any (e.g., one or more or all) pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any (e.g., one or more or all) purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides).

A chemically-modified short interfering nucleic acid (siNA) molecule capable of mediating RNA interference (RNAi) against hsp47 inside a cell or reconstituted in vitro system may include a sense region, wherein one or more pyrimidine nucleotides present in the sense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and one or more purine nucleotides present in the sense region are 2'-deoxy purine nucleotides (e.g., wherein all purine nucleotides are 2'-deoxy purine nucleotides or alternately a plurality of purine nucleotides are 2'-deoxy purine nucleotides), and an antisense region, wherein one or more pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and one or more purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides). The sense region and/or the antisense region can have a terminal cap modification, such as any modification, that is optionally present at the 3'-end, the 5'-end, or both of the 3' and 5'-ends of the sense and/or antisense sequence. The sense and/or antisense region can optionally further include a 3'-terminal nucleotide overhang having about 1 to about 4 (e.g., about 1, 2, 3, or 4) 2'-deoxynucleotides. The overhang nucleotides can further include one or more (e.g., about 1, 2, 3, 4 or more) phosphorothioate, phosphonoacetate, and/or thiophosphonoacetate internucleotide linkages. The purine nucleotides in the sense region may alternatively be 2'-O-methyl purine nucleotides (e.g., wherein all purine nucleotides are 2'-O-methyl purine nucleotides or alternately a plurality of purine nucleotides are 2'-O-methyl purine nucleotides) and one or more purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides). One or more purine nucleotides in the sense region may alternatively be purine ribonucleotides (e.g., wherein all purine nucleotides are purine ribonucleotides or alternately a plurality of purine nucleotides are purine ribonucleotides) and any purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides). One or more purine nucleotides in the sense region and/or present in the antisense region may alternatively selected from the group consisting of 2'-deoxy nucleotides, locked nucleic acid (LNA) nucleotides, 2'-methoxyethyl nucleotides, 4'-thionucleotides, and 2'-O-methyl nucleotides (e.g., wherein all purine nucleotides are selected from the group consisting of 2'-deoxy nucleotides, locked nucleic acid (LNA) nucleotides, 2'-methoxyethyl nucleotides, 4'-thionucleotides, and 2'-O-methyl nucleotides or alternately a plurality of purine nucleotides are selected from the group consisting of 2'-deoxy nucleotides, locked nucleic acid (LNA) nucleotides, 2'-methoxyethyl nucleotides, 4'-thionucleotides, and 2'-O-methyl nucleotides).

In some embodiments, a nucleic acid molecule (e.g., a siNA molecule) as described herein includes a modified nucleotide (for example one modified nucleotide) in the antisense strand; for example in position 6 or position 7 of the antisense strand.

Modification Patterns and Alternating Modifications

Nucleic acid molecules (e.g., siNA molecules) provided herein may have patterns of modified and unmodified nucleic acids. A pattern of modification of the nucleotides in a contiguous stretch of nucleotides may be a modification contained within a single nucleotide or group of nucleotides that are covalently linked to each other via standard phosphodiester bonds or, at least partially, through phosphorothioate bonds. Accordingly, a "pattern" as contemplated herein, does not necessarily need to involve repeating units, although it may. Examples of modification patterns that may be used in conjunction with the nucleic acid molecules (e.g., siNA molecules) provided herein include those disclosed in Giese, U.S. Pat. No. 7,452,987. For example, nucleic acid molecules (e.g., siNA molecules) provided herein include those having modification patters such as, similar to, or the same as, the patterns shown diagrammatically in FIG. 2 of the Giese U.S. Pat. No. 7,452,987.

A modified nucleotide or group of modified nucleotides may be at the 5'-end or 3'-end of the sense or antisense strand, a flanking nucleotide or group of nucleotides is arrayed on both sides of the modified nucleotide or group, where the flanking nucleotide or group either is unmodified or does not have the same modification of the preceding nucleotide or group of nucleotides. The flanking nucleotide or group of nucleotides may, however, have a different modification. This sequence of modified nucleotide or group of modified nucleotides, respectively, and unmodified or differently modified nucleotide or group of unmodified or differently modified nucleotides may be repeated one or more times.

In some patterns, the 5'-terminal nucleotide of a strand is a modified nucleotide while in other patterns the 5'-terminal nucleotide of a strand is an unmodified nucleotide. In some patterns, the 5'-end of a strand starts with a group of modified nucleotides while in other patterns, the 5'-terminal end is an unmodified group of nucleotides. This pattern may be either on the first stretch or the second stretch of the nucleic acid molecule or on both.

Modified nucleotides of one strand of the nucleic acid molecule may be complementary in position to the modified or unmodified nucleotides or groups of nucleotides of the other strand.

There may be a phase shift between modifications or patterns of modifications on one strand relative to the pattern of modification of the other strand such that the modification groups do not overlap. In one instance, the shift is such that the modified group of nucleotides of the sense strand corresponds to the unmodified group of nucleotides of the antisense strand and vice versa.

There may be a partial shift of the pattern of modification such that the modified groups overlap. The groups of modified nucleotides in any given strand may optionally be the same length, but may be of different lengths. Similarly, groups of unmodified nucleotides in any given strand may optionally be the same length, or of different lengths.

In some patterns, the second (penultimate) nucleotide at the terminus of the strand, is an unmodified nucleotide or the beginning of group of unmodified nucleotides. Preferably, this unmodified nucleotide or unmodified group of nucleotides is located at the 5'-end of the either or both the sense and antisense strands and even more preferably at the terminus of the sense strand. An unmodified nucleotide or unmodified group of nucleotide may be located at the 5'-end of the sense strand. In a preferred embodiment the pattern consists of alternating single modified and unmodified nucleotides.

In some double stranded nucleic acid molecules include a 2'-O-methyl modified nucleotide and a non-modified nucleotide, preferably a nucleotide which is not 2'-O-methyl modified, are incorporated on both strands in an alternating fashion, resulting in a pattern of alternating 2'-O-methyl modified nucleotides and nucleotides that are either unmodified or at least do not include a 2'-O-methyl modification. In certain embodiments, the same sequence of 2'-O-methyl modification and non-modification exists on the second strand; in other embodiments the alternating 2'-O-methyl modified nucleotides are only present in the sense strand and are not present in the antisense strand; and in yet other embodiments the alternating 2'-O-methyl modified nucleotides are only present in the sense strand and are not present in the antisense strand. In certain embodiments, there is a phase shift between the two strands such that the 2'-O-methyl modified nucleotide on the first strand base pairs with a non-modified nucleotide(s) on the second strand and vice versa. This particular arrangement, i.e. base pairing of 2'-O-methyl modified and non-modified nucleotide(s) on both strands is particularly preferred in certain embodiments. In certain embodiments, the pattern of alternating 2'-O-methyl modified nucleotides exists throughout the entire nucleic acid molecule; or the entire duplex region. In other embodiments the pattern of alternating 2'-O-methyl modified nucleotides exists only in a portion of the nucleic acid; or the entire duplex region.

In "phase shift" patterns, it may be preferred if the antisense strand starts with a 2'-O-methyl modified nucleotide at the 5' end whereby consequently the second nucleotide is non-modified, the third, fifth, seventh and so on nucleotides are thus again 2'-O-methyl modified whereas the second, fourth, sixth, eighth and the like nucleotides are non-modified nucleotides.

Exemplary Modification Locations and Patterns

While exemplary patterns are provided in more detail below, all permutations of patterns with of all possible characteristics of the nucleic acid molecules disclosed herein and those known in the art are contemplated (e.g., characteristics include, but are not limited to, length of sense strand, length of antisense strand, length of duplex region, length of hangover, whether one or both ends of a double stranded nucleic acid molecule is blunt or has an overhang, location of modified nucleic acid, number of modified nucleic acids, types of modifications, whether a double overhang nucleic acid molecule has the same or different number of nucleotides on the overhang of each side, whether a one or more than one type of modification is used in a nucleic acid molecule, and number of contiguous modified/unmodified nucleotides). With respect to all detailed examples provided below, while the duplex region is shown to be 19 nucleotides, the nucleic acid molecules provided herein can have a duplex region ranging from 1 to 49 nucleotides in length as each strand of a duplex region can independently be 17-49 nucleotides in length Exemplary patterns are provided herein.

Nucleic acid molecules may have a blunt end (when n is 0) on both ends that include a single or contiguous set of modified nucleic acids. The modified nucleic acid may be located at any position along either the sense or antisense strand. Nucleic acid molecules may include a group of about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48 or 49 contiguous modified nucleotides. Modified nucleic acids may make up 1%, 2%, 3%, 5%, 10%, 15%, 20%, 25%, 30%, 35%, 40%, 45%, 50%, 55%, 60%, 65%, 70%, 75%, 80%, 85%, 90%, 95%, 97%, 98% or 100% of a nucleic acid strand. Modified nucleic acids of the examples immediately below may be in the sense strand only, the antisense strand only, or in both the sense and antisense strand.

General nucleic acid patters are shown below where X=sense strand nucleotide in the duplex region; $X_a$=5'-overhang nucleotide in the sense strand; $X_b$=3'-overhang nucleotide in the sense strand; Y=antisense strand nucleotide in the duplex region; $Y_a$=3'-overhang nucleotide in the antisense strand; $Y_b$=5'-overhang nucleotide in the antisense strand; and M=a modified nucleotide in the duplex region. Each a and b are independently 0 to 8 (e.g., 0, 1, 2, 3, 4, 5, 6, 7 or 8). Each X, Y, a and b are independently modified or unmodified. The sense and antisense strands can are each independently 17-49 nucleotides in length. The examples provided below have a duplex region of 19 nucleotides; however, nucleic acid molecules disclosed herein can have a duplex region anywhere between 17 and 49 nucleotides and where each strand is independently between 17 and 49 nucleotides in length.

```
5'       XaXXXXXXXXXXXXXXXXXXXXb
3'       YbYYYYYYYYYYYYYYYYYYYa
```

Further exemplary nucleic acid molecule patterns are shown below where X=unmodified sense strand nucleotides; x=an unmodified overhang nucleotide in the sense strand; Y=unmodified antisense strand nucleotides; y=an unmodified overhang nucleotide in the antisense strand; and M=a modified nucleotide. The sense and antisense strands can are each independently 17-49 nucleotides in length. The examples provided below have a duplex region of 19 nucleotides; however, nucleic acid molecules disclosed herein can have a duplex region anywhere between 17 and 49 nucleotides and where each strand is independently between 17 and 49 nucleotides in length.

```
5'       MnXXXXXXXXXMXXXXXXXXXMn
3'       MnYYYYYYYYYYYYYYYYYYYMn

5'       XXXXXXXXXXXXXXXXXXX
3'       YYYYYYYYYMYYYYYYYYY

5'       XXXXXXXXXMMXXXXXXXXX
3'       YYYYYYYYYYYYYYYYYYY

5'       XXXXXXXXXXXXXXXXXXX
3'       YYYYYYYYMMYYYYYYYYY

5'       XXXXXXXXXMXXXXXXXXX
3'       YYYYYYYYYMYYYYYYYYY

5'       XXXXXMXXXXXXXXXXXXX
3'       YYYYYYYYYMYYYYYYYYY

5'       MXXXXXXXXXXXXXXXXXX
3'       YYYYYYYYYYYYMYYYYY

5'       XXXXXXXXXXXXXXXXXXM
3'       YYYYMYYYYYYYYYYYYYY

5'       XXXXXXXXXMXXXXXXXXX
3'       MYYYYYYYYYYYYYYYYYY

5'       XXXXXXXMXXXXXXXXXXX
3'       YYYYYYYYYYYYYYYYYM

5'       XXXXXXXXXXXXMXXXX
3'       MYYYYYYYYYYYYYYYYY

5'       MMMMMMMMMMMMMMMMM
3'       MMMMMMMMMMMMMMMMM
```

Nucleic acid molecules may have blunt ends on both ends with alternating modified nucleic acids. The modified nucleic acids may be located at any position along either the sense or antisense strand.

```
5'       MXMXMXMXMXMXMXMXMXM
3'       YMYMYMYMYMYMYMYMYMY

5'       XMXMXMXMXMXMXMXMXMX
3'       MYMYMYMYMYMYMYMYMYM

5'       MMXMMXMMXMMXMMXMMXM
3'       YMMYMMYMMYMMYMMYMMY

5'       XMMXMMXMMXMMXMMXMMX
3'       MMYMMYMMYMMYMMYMMYM

5'       MMMXMMMXMMMXMMMXMMM
3'       YMMMYMMMYMMMYMMMYMM

5'       XMMMXMMMXMMMXMMMXMM
3'       MMMYMMMYMMMYMMMYMMM
```

Nucleic acid molecules with a blunt 5'-end and 3'-end overhang end with a single modified nucleic acid.

Nucleic acid molecules with a 5'-end overhang and a blunt 3'-end with a single modified nucleic acid.

Nucleic acid molecules with overhangs on both ends and all overhangs are modified nucleic acids. In the pattern immediately below, M is n number of modified nucleic acids, where n is an integer from 0 to 8 (i.e., 0, 1, 2, 3, 4, 5, 6, 7 and 8).

```
5'       XXXXXXXXXXXXXXXXXXXM
3'       MYYYYYYYYYYYYYYYYYYY
```

Nucleic acid molecules with overhangs on both ends and some overhang nucleotides are modified nucleotides. In the patterns immediately below, M is n number of modified nucleotides, x is n number of unmodified overhang nucleotides in the sense strand, y is n number of unmodified overhang nucleotides in the antisense strand, where each n is independently an integer from 0 to 8 (i.e., 0, 1, 2, 3, 4, 5, 6, 7 and 8), and where each overhang is maximum of 20 nucleotides; preferably a maximum of 8 nucleotides (modified and/or unmodified).

```
5'       XXXXXXXXXXXXXXXXXXXM
3'       yYYYYYYYYYYYYYYYYYYY

5'       XXXXXXXXXXXXXXXXXXXMx
3'       yYYYYYYYYYYYYYYYYYYY

5'       XXXXXXXXXXXXXXXXXXXMxM
3'       yYYYYYYYYYYYYYYYYYYY

5'       XXXXXXXXXXXXXXXXXXXMxMx
3'       yYYYYYYYYYYYYYYYYYYY

5'       XXXXXXXXXXXXXXXXXXXMxMxM
3'       yYYYYYYYYYYYYYYYYYYY

5'       XXXXXXXXXXXXXXXXXXXMxMxMx
3'       yYYYYYYYYYYYYYYYYYYY

5'       XXXXXXXXXXXXXXXXXXXMxMxMxM
3'       yYYYYYYYYYYYYYYYYYYY

5'       XXXXXXXXXXXXXXXXXXXMxMxMxMx
3'       yYYYYYYYYYYYYYYYYYYY

5'       MXXXXXXXXXXXXXXXXXXX
3'       YYYYYYYYYYYYYYYYYYYy

5'       xMXXXXXXXXXXXXXXXXXXX
3'       YYYYYYYYYYYYYYYYYYYy

5'       MxMXXXXXXXXXXXXXXXXXX
3'       YYYYYYYYYYYYYYYYYYYy

5'       xMxMXXXXXXXXXXXXXXXXXX
3'       YYYYYYYYYYYYYYYYYYYy

5'       MxMxMXXXXXXXXXXXXXXXXXX
```

```
3'           YYYYYYYYYYYYYYYYYYYYy

5'      xMxMxMXXXXXXXXXXXXXXXXXX
3'           YYYYYYYYYYYYYYYYYYYYy

5'      MxMxMxMXXXXXXXXXXXXXXXXXX
3'           YYYYYYYYYYYYYYYYYYYYy

5'      xMxMxMxMXXXXXXXXXXXXXXXXXX
3'           YYYYYYYYYYYYYYYYYYYYy

5'           xXXXXXXXXXXXXXXXXXX
3'           YYYYYYYYYYYYYYYYYYYYM

5'           xXXXXXXXXXXXXXXXXXX
3'           YYYYYYYYYYYYYYYYYYYYMy

5'           xXXXXXXXXXXXXXXXXXX
3'           YYYYYYYYYYYYYYYYYYYYMyM

5'           xXXXXXXXXXXXXXXXXXX
3'           YYYYYYYYYYYYYYYYYYYYMyMy

5'           xXXXXXXXXXXXXXXXXXX
3'           YYYYYYYYYYYYYYYYYYYYMyMyM

5'           xXXXXXXXXXXXXXXXXXX
3'           YYYYYYYYYYYYYYYYYYYYMyMyMy

5'           xXXXXXXXXXXXXXXXXXX
3'           YYYYYYYYYYYYYYYYYYYYMyMyMyM

5'           xXXXXXXXXXXXXXXXXXX
3'           YYYYYYYYYYYYYYYYYYYYMyMyMyMy

5'           XXXXXXXXXXXXXXXXXXx
3'           MYYYYYYYYYYYYYYYYYYY

5'           XXXXXXXXXXXXXXXXXXx
3'          yMYYYYYYYYYYYYYYYYYYY

5'           XXXXXXXXXXXXXXXXXXx
3'          MyMYYYYYYYYYYYYYYYYYYY

5'           XXXXXXXXXXXXXXXXXXx
3'         yMyMYYYYYYYYYYYYYYYYYYY

5'           XXXXXXXXXXXXXXXXXXx
3'        MyMyMYYYYYYYYYYYYYYYYYYY

5'           XXXXXXXXXXXXXXXXXXx
3'       yMyMyMYYYYYYYYYYYYYYYYYYY

5'           XXXXXXXXXXXXXXXXXXx
3'      MyMyMyMYYYYYYYYYYYYYYYYYYY

5'           XXXXXXXXXXXXXXXXXXx
3'     yMyMyMyMYYYYYYYYYYYYYYYYYYY
```

Modified nucleotides at the 3' end of the sense region.

```
5'           XXXXXXXXXXXXXXXXXXM
3'           YYYYYYYYYYYYYYYYYYY

5'           XXXXXXXXXXXXXXXXXXMM
3'           YYYYYYYYYYYYYYYYYYY

5'           XXXXXXXXXXXXXXXXXXMMM
3'           YYYYYYYYYYYYYYYYYYY

5'           XXXXXXXXXXXXXXXXXXMMMM
3'           YYYYYYYYYYYYYYYYYYY

5'           XXXXXXXXXXXXXXXXXXMMMMM
3'           YYYYYYYYYYYYYYYYYYY

5'           XXXXXXXXXXXXXXXXXXMMMMMM
3'           YYYYYYYYYYYYYYYYYYY

5'           XXXXXXXXXXXXXXXXXXMMMMMMM
3'           YYYYYYYYYYYYYYYYYYY

5'           XXXXXXXXXXXXXXXXXXMMMMMMMM
3'           YYYYYYYYYYYYYYYYYYY
```

Overhang at the 5' end of the sense region.

```
5'           MXXXXXXXXXXXXXXXXXX
3'           YYYYYYYYYYYYYYYYYYY

5'           MMXXXXXXXXXXXXXXXXXX
3'           YYYYYYYYYYYYYYYYYYY

5'           MMMXXXXXXXXXXXXXXXXXX
3'           YYYYYYYYYYYYYYYYYYY

5'           MMMMXXXXXXXXXXXXXXXXXX
3'           YYYYYYYYYYYYYYYYYYY

5'           MMMMMXXXXXXXXXXXXXXXXXX
3'           YYYYYYYYYYYYYYYYYYY

5'           MMMMMMXXXXXXXXXXXXXXXXXX
3'           YYYYYYYYYYYYYYYYYYY

5'           MMMMMMMXXXXXXXXXXXXXXXXXX
3'           YYYYYYYYYYYYYYYYYYY

5'           MMMMMMMMXXXXXXXXXXXXXXXXXX
3'           YYYYYYYYYYYYYYYYYYY
```

Overhang at the 3' end of the antisense region.

```
5'           XXXXXXXXXXXXXXXXXX
3'           MYYYYYYYYYYYYYYYYYYY

5'           XXXXXXXXXXXXXXXXXX
3'           MMYYYYYYYYYYYYYYYYYYY

5'           XXXXXXXXXXXXXXXXXX
3'           MMMYYYYYYYYYYYYYYYYYYY

5'           XXXXXXXXXXXXXXXXXX
3'           MMMMYYYYYYYYYYYYYYYYYYY

5'           XXXXXXXXXXXXXXXXXX
3'           MMMMMYYYYYYYYYYYYYYYYYYY

5'           XXXXXXXXXXXXXXXXXX
3'           MMMMMMYYYYYYYYYYYYYYYYYYY

5'           XXXXXXXXXXXXXXXXXX
3'           MMMMMMMYYYYYYYYYYYYYYYYYYY

5'           XXXXXXXXXXXXXXXXXX
3'           MMMMMMMMYYYYYYYYYYYYYYYYYYY
```

Modified nucleotide(s) within the sense region

```
5'           XXXXXXXXMXXXXXXXXX
3'           YYYYYYYYYYYYYYYYYYY

5'           XXXXXXXXXXXXXXXXXX
3'           YYYYYYYYYMYYYYYYYYY

5'           XXXXXXXXXXXXXXXXXXMM
3'           YYYYYYYYYYYYYYYYYYY

5'           XXXXXXXXXXXXXXXXXX
3'           MMYYYYYYYYYYYYYYYYYYY
```

Exemplary nucleic acid molecules are provided below along with the equivalent general structure in line with the symbols used above:

siHSP47-C siRNA to human and rat hsp47 having a 19 nucleotide (i.e., 19mer) duplex region and modified 2 nucleotide (i.e., deoxynucleotide) overhangs at the 3'-ends of the sense and antisense strands.

```
5'      GGACAGGCCUCUACAACUAdTdT      3'
3'      dTdTCCUGUCCGGAGAUGUUGAU      5'

5'      XXXXXXXXXXXXXXXXXXXMM        3'
3'      MMYYYYYYYYYYYYYYYYYYY        5'
``` siHSP47-Cd siRNA to human and rat hsp47 having a 25-mer duplex region, a 2 nucleotide overhang at the 3'-end of the antisense strand and 2 modified nucleotides at the 5'-terminal and penultimate positions of the sense strand.

```
5'      GGACAGGCCUCUACAACUACUACdGdA      3'
3'      UUCCUGUCCGGAGAUGUUGAUGAUGCU      5'

5'      XXXXXXXXXXXXXXXXXXXXXXXMM        3'
3'      yyYYYYYYYYYYYYYYYYYYYYYYY        5'
``` siHSP47-1 siRNA to human and rat hsp47 cDNA 719-737 having a 19-mer duplex region, and modified 2 nucleotide (i.e., deoxynucleotide) overhangs at the 3'-ends of the sense and antisense strands.

```
5'      CAGGCCUCUACAACUACUAdTdT      3'
3'      dTdTGUCCGGAGAUGUUGAUGAU      5'

5'      XXXXXXXXXXXXXXXXXXXMM        3'
3'      MMYYYYYYYYYYYYYYYYYYY        5'
``` siHSP47-1d siRNA to human hsp47 cDNA 719-743 having a 25-mer with a blunt end at the 3'-end of the sense strand and a 2 nucleotide overhang at the 3'-end of the antisense strand, and 2 modified nucleotides at the 5'-terminal and penultimate positions of the sense strand.

```
5'      CAGGCCUCUACAACUACUACGACdGdA      3'
3'      UUGUCCGGAGAUGUUGAUGAUGCUGCU      5'

5'      XXXXXXXXXXXXXXXXXXXXXXXMM        3'
3'      yyYYYYYYYYYYYYYYYYYYYYYYY        5'
``` siHSP47-2 siRNA to human hsp47 cDNA 469-487 having a 19-mer duplex region, and modified 2 nucleotide (i.e., deoxynucleotide) overhangs at the 3'-ends of the sense and antisense strands.

```
5'      GAGCACUCCAAGAUCAACUdTdT      3'
3'      dTdTCUCGUGAGGUUCUAGUUGA      5'

5'      XXXXXXXXXXXXXXXXXXXMM        3'
3'      MMYYYYYYYYYYYYYYYYYYY        5'
``` siHSP47-2d siRNA to human hsp47 cDNA 469-493 having a 25-mer duplex region with a blunt end at the 3'-end of the sense strand and a 2 nucleotide overhang at the 3'-end of the antisense strand, and 2 modified nucleotides at the 5'-terminal and penultimate positions of the sense strand.

```
5'      GAGCACUCCAAGAUCAACUUCCGdCdG      3'
3'      UUCUCGUGAGGUUCUAGUUGAAGGCGC      5'

5'      XXXXXXXXXXXXXXXXXXXXXXXMM        3'
3'      yyYYYYYYYYYYYYYYYYYYYYYYY        5'
``` siHSP47-2d rat siRNA to rat Gp46 cDNA 466-490 having a 25-mer duplex region with a blunt end at the 3'-end of the sense strand and a 2 nucleotide overhang at the 3'-end of the antisense strand, and 2 modified nucleotides at the 5'-terminal and penultimate positions of the sense strand.

```
5'      GAACACUCCAAGAUCAACUUCCGdAdG      3'
3'      UUCUUGUGAGGUUCUAGUUGAAGGCUC      5'

5'      XXXXXXXXXXXXXXXXXXXXXXXMM        3'
3'      yyYYYYYYYYYYYYYYYYYYYYYYY        5'
``` siHSP47-3 siRNA to human hsp47 cDNA 980-998 having a 19-mer duplex region, and modified 2 nucleotide (i.e., deoxynucleotide) overhangs at the 3'-ends of the sense and antisense strands.

```
5'      CTGAGGCCATTGACAAGAAdTdT      3'
3'      dTdTGACUCCGGUAACUGUUCUU      5'

5'      XXXXXXXXXXXXXXXXXXXMM        3'
3'      MMYYYYYYYYYYYYYYYYYYY        5'
``` siHSP47-3d siRNA to human hsp47 cDNA 980-1004 having a 25-mer duplex region with a blunt end at the 3'-end of the sense strand and a 2 nucleotide overhang at the 3'-end of the antisense strand, and 2 modified nucleotides at the 5'-terminal and penultimate positions of the sense strand.

```
5'      CTGAGGCCATTGACAAGAACAAGdGdC      3'
3'      UUGACUCCGGUAACUGUUCUUGUUCCG      5'

5'      XXXXXXXXXXXXXXXXXXXXXXXMM        3'
3'      yyYYYYYYYYYYYYYYYYYYYYYYY        5'
``` siHSP47-4 siRNA to human hsp47 cDNA 735-753 having a 19-mer duplex region, and modified 2 nucleotide (i.e., deoxynucleotide) overhangs at the 3'-ends of the sense and antisense strands.

```
5'      CUACGACGACGAGAAGGAAdTdT      3'
3'      dTdTGAUGCUGCUGCUCUUCCUU      5'

5'      XXXXXXXXXXXXXXXXXXXMM        3'
3'      MMYYYYYYYYYYYYYYYYYYY        5'
``` siHSP47-4-d siRNA to human hsp47 cDNA 735-759 having a 25-mer duplex region with a blunt end at the 3'-end of the sense strand and a 2 nucleotide overhang at the 3'-end of the antisense strand, and 2 modified nucleotides at the 5'-terminal and penultimate positions of the sense strand.

```
5'      CUACGACGACGAGAAGGAAAAGCdTdG      3'
3'      UUGAUGCUGCUGCUCUUCCUUUUCGAC      5'

5'      XXXXXXXXXXXXXXXXXXXXXXXMM        3'
3'      yyYYYYYYYYYYYYYYYYYYYYYYY        5'
``` siHSP47-5 siRNA to human hsp47 cDNA 621-639 having a 19-mer duplex region, and modified 2 nucleotide (i.e., deoxynucleotide) overhangs at the 3'-ends of the sense and antisense strands.

```
5'      GCCACACUGGGAUGAGAAAdTdT      3'
3'      dTdTCGGUGUGACCCUACUCUUU      5'

5'      XXXXXXXXXXXXXXXXXXXMM        3'
3'      MMYYYYYYYYYYYYYYYYYYY        5'
``` siHSP47-6 siRNA to human hsp47 cDNA 446-464 having a 19-mer duplex region, and modified 2 nucleotide (i.e., deoxynucleotide) overhangs at the 3'-ends of the sense and antisense strands.

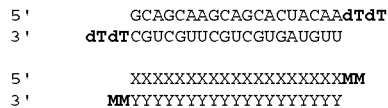

siHSP47-7 siRNA to human hsp47 cDNA 692-710 having a 19-mer duplex region, and modified 2 nucleotide (i.e., deoxynucleotide) overhangs at the 3'-ends of the sense and antisense strands.

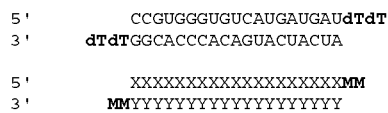

Nicks and Gaps in Nucleic Acid Strands

Nucleic acid molecules (e.g., siNA molecules) provided herein may have a strand, preferably the sense strand, that is nicked or gapped. As such, nucleic acid molecules may have three or more strand, for example, such as a meroduplex RNA (mdRNA) disclosed in International Patent Application No. PCT/US07/081,836. Nucleic acid molecules with a nicked or gapped strand may be between about 1-49 nucleotides, or may be RISC length (e.g., about 15 to 25 nucleotides) or Dicer substrate length (e.g., about 25 to 30 nucleotides) such as disclosed herein.

Nucleic acid molecules with three or more strands include, for example, an 'A' (antisense) strand, 'S1' (second) strand, and 'S2' (third) strand in which the 'S1' and 'S2' strands are complementary to and form base pairs with non-overlapping regions of the 'A' strand (e.g., an mdRNA can have the form of A:S1S2). The S1, S2, or more strands together form what is substantially similar to a sense strand to the 'A' antisense strand. The double-stranded region formed by the annealing of the 'S1' and 'A' strands is distinct from and non-overlapping with the double-stranded region formed by the annealing of the 'S2' and 'A' strands. An nucleic acid molecule (e.g., an siNA molecule) may be a "gapped" molecule, meaning a "gap" ranging from 0 nucleotides up to about 10 nucleotides (e.g., 0, 1, 2, 3, 4, 5, 6, 7, 8, 9 or 10 nucleotides). Preferably, the sense strand is gapped. In some embodiments, the A:S1 duplex is separated from the A:S2 duplex by a gap resulting from at least one unpaired nucleotide (up to about 10 unpaired nucleotides) in the 'A' strand that is positioned between the A:S1 duplex and the A:S2 duplex and that is distinct from any one or more unpaired nucleotide at the 3'-end of one or more of the 'A', 'S1', or 'S2' strands. The A:S1 duplex may be separated from the A:B2 duplex by a gap of zero nucleotides (i.e., a nick in which only a phosphodiester bond between two nucleotides is broken or missing in the polynucleotide molecule) between the A:S1 duplex and the A:S2 duplex-which can also be referred to as nicked dsRNA (ndsRNA). For example, A:S1S2 may be include a dsRNA having at least two double-stranded regions that combined total about 14 base pairs to about 40 base pairs and the double-stranded regions are separated by a gap of about 0 to about 10 nucleotides, optionally having blunt ends, or A:S1S2 may include a dsRNA having at least two double-stranded regions separated by a gap of up to 10 nucleotides wherein at least one of the double-stranded regions includes between about 5 base pairs and 13 base pairs.

Dicer Substrates

In certain embodiments, the nucleic acid molecules (e.g., siNA molecules) provided herein may be a precursor "Dicer substrate" molecule, e.g., double stranded nucleic acid, processed in vivo to produce an active nucleic acid molecules, for example as described in Rossi, US Patent App. No. 20050244858. In certain conditions and situations, it has been found that these relatively longer dsRNA siNA species, e.g., of from about 25 to about 30 nucleotides, can give unexpectedly effective results in terms of potency and duration of action. Without wishing to be bound by any particular theory, it is thought that the longer dsRNA species serve as a substrate for the enzyme Dicer in the cytoplasm of a cell. In addition to cleaving double stranded nucleic acid into shorter segments, Dicer may facilitate the incorporation of a single-stranded cleavage product derived from the cleaved dsRNA into the RNA-induced silencing complex (RISC complex) that is responsible for the destruction of the cytoplasmic RNA derived from the target gene.

Dicer substrates may have certain properties which enhance its processing by Dicer. Dicer substrates are of a length sufficient such that it is processed by Dicer to produce an active nucleic acid molecule and may further include one or more of the following properties: (i) the dsRNA is asymmetric, e.g., has a 3' overhang on the first strand (antisense strand) and (ii) the dsRNA has a modified 3' end on the antisense strand (sense strand) to direct orientation of Dicer binding and processing of the dsRNA to an active siRNA. In certain embodiments, the longest strand in the Dicer substrate may be 24-30 nucleotides.

Dicer substrates may be symmetric or asymmetric. The Dicer substrate may have a sense strand includes 22-28 nucleotides and the antisense strand may include 24-30 nucleotides; thus, in some embodiments the resulting Dicer substrate may have an overhang on the 3' end of the antisense strand. Dicer substrate may have a sense strand 25 nucleotides in length, and the antisense strand having 27 nucleotides in length with a 2 base 3'-overhang. The overhang may be 1-3 nucleotides, for example 2 nucleotides. The sense strand may also have a 5' phosphate.

An asymmetric Dicer substrate may further contain two deoxynucleotides at the 3'-end of the sense strand in place of two of the ribonucleotides. Some exemplary Dicer substrates lengths and structures are 21+0, 21+2, 21−2, 22+0, 22+1, 22−1, 23+0, 23+2, 23−2, 24+0, 24+2, 24−2, 25+0, 25+2, 25−2, 26+0, 26+2, 26−2, 27+0, 27+2, and 27−2.

The sense strand of a Dicer substrate may be between about 22 to about 30 (e.g., about 22, 23, 24, 25, 26, 27, 28, 29 or 30); about 22 to about 28; about 24 to about 30; about 25 to about 30; about 26 to about 30; about 26 and 29; or about 27 to about 28 nucleotides in length. In certain preferred embodiments Dicer substrates contain sense and antisense strands, that are at least about 25 nucleotides in length and no longer than about 30 nucleotides; between about 26 and 29 nucleotides; or 27 nucleotides in length. The sense and antisense strands may be the same length (blunt ended), different lengths (have overhangs), or a combination. The sense and antisense strands may exist on the same polynucleotide or on different polynucleotides. A Dicer substrate may have a duplex region of about 19, 20, 21, 22, 23, 24, 25 or 27 nucleotides.

Like other siNA molecules provided herein, the antisense strand of a Dicer substrate may have any sequence that anneals to the antisense strand under biological conditions, such as within the cytoplasm of a eukaryotic cell.

Dicer substrates may have any modifications to the nucleotide base, sugar or phosphate backbone as known in the art and/or as described herein for other nucleic acid molecules (such as siNA molecules). In certain embodiments, Dicer substrates may have a sense strand is modified for Dicer processing by suitable modifiers located at the 3' end of the sense strand, i.e., the dsRNA is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for-the 2'-deoxyribofuranosyl sugar normally present in dNMPs. Other nucleotides modifiers that could be used in Dicer substrate siNA molecules include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dide-oxythymidine (d4T). In one embodiment, deoxynucleotides are used as the modifiers. When nucleotide modifiers are utilized, they may replace ribonucleotides (e.g., 1-3 nucleotide modifiers, or 2 nucleotide modifiers are substituted for the ribonucleotides on the 3' end of the sense strand) such that the length of the Dicer substrate does not change. When sterically hindered molecules are utilized, they may be attached to the ribonucleotide at the 3' end of the antisense strand. Thus, in certain embodiments the length of the strand does not change with the incorporation of the modifiers. In certain embodiments, two DNA bases in the dsRNA are substituted to direct the orientation of Dicer processing of the antisense strand. In a further embodiment of two terminal DNA bases are substituted for two ribonucleotides on the 3'-end of the sense strand forming a blunt end of the duplex on the 3' end of the sense strand and the 5' end of the antisense strand, and a two-nucleotide RNA overhang is located on the 3'-end of the antisense strand. This is an asymmetric composition with DNA on the blunt end and RNA bases on the overhanging end.

In certain embodiments modifications are included in the Dicer substrate such that the modification does not prevent the nucleic acid molecule from serving as a substrate for Dicer. In one embodiment, one or more modifications are made that enhance Dicer processing of the Dicer substrate. One or more modifications may be made that result in more effective RNAi generation. One or more modifications may be made that support a greater RNAi effect. One or more modifications are made that result in greater potency per each Dicer substrate to be delivered to the cell. Modifications may be incorporated in the 3'-terminal region, the 5'-terminal region, in both the 3'-terminal and 5'-terminal region or at various positions within the sequence. Any number and combination of modifications can be incorporated into the Dicer substrate so long as the modification does not prevent the nucleic acid molecule from serving as a substrate for Dicer. Where multiple modifications are present, they may be the same or different. Modifications to bases, sugar moieties, the phosphate backbone, and their combinations are contemplated. Either 5'-terminus can be phosphorylated.

Examples of Dicer substrate phosphate backbone modifications include phosphonates, including methylphosphonate, phosphorothioate, and phosphotriester modifications such as alkylphosphotriesters, and the like. Examples of Dicer substrate sugar moiety modifications include 2'-alkyl pyrimidine, such as 2'-O-methyl, 2'-fluoro, amino, and deoxy modifications and the like (see, e.g., Amarzguioui et al., 2003). Examples of Dicer substrate base group modifications include abasic sugars, 2-O-alkyl modified pyrimidines, 4-thiouracil, 5-bromouracil, 5-iodouracil, and 5-(3-aminoallyl)-uracil and the like. Locked nucleic acids, or LNA's, could also be incorporated.

The sense strand may be modified for Dicer processing by suitable modifiers located at the 3' end of the sense strand, i.e., the Dicer substrate is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for-the 2'-deoxyribofuranosyl sugar normally present in dNMPs. Other nucleotides modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dide-oxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the sense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the Dicer substrate to direct the orientation of Dicer processing of the antisense strand. In a further embodiment of the present invention, two terminal DNA bases are substituted for two ribonucleotides on the 3'-end of the sense strand forming a blunt end of the duplex on the 3' end of the sense strand and the 5' end of the antisense strand, and a two-nucleotide RNA overhang is located on the 3'-end of the antisense strand. This is an asymmetric composition with DNA on the blunt end and RNA bases on the overhanging end.

The antisense strand may be modified for Dicer processing by suitable modifiers located at the 3' end of the antisense strand, i.e., the dsRNA is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dide-oxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the antisense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the antisense strand in place of two ribonucleotides forming a blunt end of the duplex on the 5' end of the sense strand and the 3' end of the antisense strand, and a two-nucleotide RNA overhang is located on the 3'-end of the sense strand. This is an asymmetric composition with DNA on the blunt end and RNA bases on the overhanging end.

Dicer substrates with a sense and an antisense strand can be linked by a third structure. The third structure will not block Dicer activity on the Dicer substrate and will not interfere with the directed destruction of the RNA transcribed from the target gene. The third structure may be a chemical linking group. Suitable chemical linking groups are known in the art and can be used. Alternatively, the third structure may be an oligonucleotide that links the two oligonucleotides of the dsRNA is a manner such that a hairpin structure is produced upon annealing of the two oligonucleotides making up the Dicer substrate. The hairpin structure preferably does not block Dicer activity on the Dicer substrate or interfere with the directed destruction of the RNA transcribed from the target gene.

The sense and antisense strands of the Dicer substrate are not required to be completely complementary. They only need to be substantially complementary to anneal under biological conditions and to provide a substrate for Dicer that produces an siRNA sufficiently complementary to the target sequence.

Dicer substrate can have certain properties that enhance its processing by Dicer. The Dicer substrate can have a length sufficient such that it is processed by Dicer to produce an active nucleic acid molecules (e.g., siRNA) and may have one or more of the following properties: (i) the Dicer substrate is asymmetric, e.g., has a 3' overhang on the first strand (antisense strand) and (ii) the Dicer substrate has a modified 3' end on the second strand (sense strand) to direct orientation of Dicer binding and processing of the Dicer substrate to an active siRNA. The Dicer substrate can be asymmetric such that the sense strand includes 22-28 nucleotides and the antisense strand includes 24-30 nucleotides. Thus, the resulting Dicer substrate has an overhang on the 3' end of the antisense strand. The overhang is 1-3 nucleotides, for example 2 nucleotides. The sense strand may also have a 5' phosphate.

A Dicer substrate may have an overhang on the 3' end of the antisense strand and the sense strand is modified for Dicer processing. The 5' end of the sense strand may have a phosphate. The sense and antisense strands may anneal under biological conditions, such as the conditions found in the cytoplasm of a cell. A region of one of the strands, particularly the antisense strand, of the Dicer substrate may have a sequence length of at least 19 nucleotides, wherein these nucleotides are in the 21-nucleotide region adjacent to the 3' end of the antisense strand and are sufficiently complementary to a nucleotide sequence of the RNA produced from the target gene. A Dicer substrate may also have one or more of the following additional properties: (a) the antisense strand has a right shift from a corresponding 21-mer (i.e., the antisense strand includes nucleotides on the right side of the molecule when compared to the corresponding 21-mer), (b) the strands may not be completely complementary, i.e., the strands may contain simple mismatch pairings and (c) base modifications such as locked nucleic acid(s) may be included in the 5' end of the sense strand.

An antisense strand of a Dicer substrate nucleic acid molecule may be modified to include 1-9 ribonucleotides on the 5'-end to give a length of 22-28 nucleotides. When the antisense strand has a length of 21 nucleotides, then 1-7 ribonucleotides, or 2-5 ribonucleotides and or 4 ribonucleotides may be added on the 3'-end. The added ribonucleotides may have any sequence. Although the added ribonucleotides may be complementary to the target gene sequence, full complementarity between the target sequence and the antisense strands is not required. That is, the resultant antisense strand is sufficiently complementary with the target sequence. A sense strand may then have 24-30 nucleotides. The sense strand may be substantially complementary with the antisense strand to anneal to the antisense strand under biological conditions. In one embodiment, the antisense strand may be synthesized to contain a modified 3'-end to direct Dicer processing. The sense strand may have a 3' overhang. The antisense strand may be synthesized to contain a modified 3'-end for Dicer binding and processing and the sense strand has a 3' overhang.

Heat Shock Protein 47

Heat shock protein 47 (HSP47) is a collagen-specific molecular chaperone and resides in the endoplasmic reticulum. It interacts with procollagen during the process of folding, assembling and transporting from the endoplasmic reticulum (Nagata Trends Biochem Sci 1996; 21:22-6; Razzaque et al. 2005; Contrib Nephrol 2005; 148: 57-69; Koide et al. 2006 J. Biol. Chem.; 281: 3432-38; Leivo et al. Dev. Biol. 1980; 76:100-114; Masuda et al. J. Clin. Invest. 1994; 94:2481-2488; Masuda et al. Cell Stress Chaperones 1998; 3:256-264). HSP47 has been reported to have an upregulated expression in various tissue fibrosis (Koide et al. J Biol Chem 1999; 274: 34523-26), such as liver cirrhosis (Masuda et al. J Clin Invest 1994; 94:2481-8), pulmonary fibrosis (Razzaque et al. Virchows Arch 1998; 432:455-60; Kakugawa et al. Eur Respir J 2004; 24: 57-65), and glomerulosclerosis (Moriyama et al. Kidney Int 1998; 54: 110-19). Exemplary nucleic acid sequence of target human hsp47 cDNA is disclosed in GenBank accession number: NM_001235 and the corresponding mRNA sequence, for example as listed as SEQ ID NO: 1. One of ordinary skill in the art would understand that a given sequence may change over time and to incorporate any changes needed in the nucleic acid molecules herein accordingly.

The specific association of HSP47 with a diverse range of collagen types makes HSP47 a potential target for the treatment of fibrosis. Inhibition of hsp47 expression may prevent extracellular collagen I secretion. Sato et al. (Nat Biotechnol 2008; 26:431-442) explored this possibility by using siRNA for the inhibition hsp47 expression and preventing the progression of hepatic fibrosis in rats. Similarly, Chen et al. (Br J Dermatol 2007; 156: 1188-1195) and Wang et al. (Plast. Reconstr Surg 2003; 111: 1980-7) investigated the inhibition hsp47 expression by RNA interference technology.

Methods and Compositions for Inhibiting hsp47

Provided are compositions and methods for inhibition of hsp47 expression by using small nucleic acid molecules, such as short interfering nucleic acid (siNA), interfering RNA (RNAi), short interfering RNA (siRNA), double-stranded RNA (dsRNA), micro-RNA (miRNA), and short hairpin RNA (shRNA) molecules capable of mediating or that mediate RNA interference against hsp47 gene expression. The composition and methods disclosed herein are also useful in treating various fibrosis such as liver fibrosis, lung fibrosis, and kidney fibrosis.

Nucleic acid molecule(s) and/or methods of the invention are used to down regulate the expression of gene(s) that encode RNA referred to, by example, Genbank Accession NM_001235.

Compositions, methods and kits provided herein may include one or more nucleic acid molecules (e.g., siNA) and methods that independently or in combination modulate (e.g., downregulate) the expression of hsp47 protein and/or genes encoding hsp47 proteins, proteins and/or genes encoding hsp47 associated with the maintenance and/or development of diseases, conditions or disorders associated with hsp47, such as liver fibrosis, cirrhosis, pulmonary fibrosis, kidney fibrosis, peritoneal fibrosis, chronic hepatic damage, and fibrillogenesis (e.g., genes encoding sequences comprising those sequences referred to by GenBank Accession Nos. NM_001235), or a hsp47 gene family member where the genes or gene family sequences share sequence homology. The description of the various aspects and embodiments is provided with reference to exemplary gene hsp47. However, the various aspects and embodiments are also directed to other related hsp47 genes, such as homolog genes and transcript variants, and polymorphisms (e.g., single nucleotide polymorphism, (SNPs)) associated with certain hsp47 genes. As such, the various aspects and embodiments are also directed to other genes that are involved in hsp47 mediated pathways of signal transduction or gene expression that are involved, for example, in the maintenance or development of diseases, traits, or conditions described herein. These additional genes can be analyzed for target sites using the methods described for the hsp47 gene herein. Thus, the modulation of other genes and the effects of such modulation of the other genes can be performed, determined, and measured as described herein.

In one embodiment, compositions and methods provided herein include a double-stranded short interfering nucleic acid (siNA) molecule that down-regulates expression of a hsp47 gene (e.g., human hsp47 exemplified by SEQ ID NO:1), where the nucleic acid molecule includes about 15 to about 49 base pairs.

In one embodiment, a nucleic acid disclosed may be used to inhibit the expression of the hsp47 gene or a hsp47 gene family where the genes or gene family sequences share sequence homology. Such homologous sequences can be identified as is known in the art, for example using sequence alignments. Nucleic acid molecules can be designed to target such homologous sequences, for example using perfectly complementary sequences or by incorporating non-canonical base pairs, for example mismatches and/or wobble base pairs, that can provide additional target sequences. In instances where mismatches are identified, non-canonical base pairs (for example, mismatches and/or wobble bases) can be used to generate nucleic acid molecules that target more than one gene sequence. In a non-limiting example, non-canonical base pairs such as UU and CC base pairs are used to generate nucleic acid molecules that are capable of targeting sequences for differing hsp47 targets that share sequence homology. As such, one advantage of using siNAs disclosed herein is that a single nucleic acid can be designed to include nucleic acid sequence that is complementary to the nucleotide sequence that is conserved between the homologous genes. In this approach, a single nucleic acid can be used to inhibit expression of more than one gene instead of using more than one nucleic acid molecule to target the different genes.

Nucleic acid molecules may be used to target conserved sequences corresponding to a gene family or gene families such as hsp47 family genes. As such, nucleic acid molecules targeting multiple hsp47 targets can provide increased therapeutic effect. In addition, nucleic acid can be used to characterize pathways of gene function in a variety of applications. For example, nucleic acid molecules can be used to inhibit the activity of target gene(s) in a pathway to determine the function of uncharacterized gene(s) in gene function analysis, mRNA function analysis, or translational analysis. The nucleic acid molecules can be used to determine potential target gene pathways involved in various diseases and conditions toward pharmaceutical development. The nucleic acid molecules can be used to understand pathways of gene expression involved in, for example fibroses such as liver, kidney or pulmonary fibrosis, and/or inflammatory and proliferative traits, diseases, disorders, and/or conditions.

In one embodiment, the compositions and methods provided herein include a nucleic acid molecule having RNAi activity against hsp47 RNA, where the nucleic acid molecule includes a sequence complementary to any RNA having hsp47 encoding sequence, such as those sequences having sequences as shown in Table I. In another embodiment, a nucleic acid molecule may have RNAi activity against hsp47 RNA, where the nucleic acid molecule includes a sequence complementary to an RNA having variant hsp47 encoding sequence, for example other mutant hsp47 genes not shown in Table I but known in the art to be associated with the maintenance and/or development of fibrosis. Chemical modifications as shown in Table I or otherwise described herein can be applied to any nucleic acid construct disclosed herein. In another embodiment, a nucleic acid molecule disclosed herein includes a nucleotide sequence that can interact with nucleotide sequence of a hsp47 gene and thereby mediate silencing of hsp47 gene expression, for example, wherein the nucleic acid molecule mediates regulation of hsp47 gene expression by cellular processes that modulate the chromatin structure or methylation patterns of the hsp47 gene and prevent transcription of the hsp47 gene.

Nucleic acid molecules disclosed herein may have RNAi activity against hsp47 RNA, where the nucleic acid molecule includes a sequence complementary to any RNA having hsp47 encoding sequence, such as those sequences having GenBank Accession Nos. NM_001235. Nucleic acid molecules may have RNAi activity against hsp47 RNA, where the nucleic acid molecule includes a sequence complementary to an RNA having variant hsp47 encoding sequence, for example other mutant hsp47 genes known in the art to be associated with the maintenance and/or development of fibrosis. Nucleic acid molecules disclosed herein include a nucleotide sequence that can interact with nucleotide sequence of a hsp47 gene and thereby mediate silencing of hsp47 gene expression, e.g., where the nucleic acid molecule mediates regulation of hsp47 gene expression by cellular processes that modulate the chromatin structure or methylation patterns of the hsp47 gene and prevent transcription of the hsp47 gene.

Methods of Treatment

The specific association of HSP47 with a diverse range of collagen types makes hsp47 a target for the treatment of fibrosis. Inhibition of hsp47 expression may prevent extracellular collagen I secretion. Sato et al. (Nat Biotechnol 2008; 26:431-442) explored this possibility by using siRNA for the inhibition hsp47 expression and preventing the progression of hepatic fibrosis in rats. Similarly, Chen et al. (Br J Dermatol 2007; 156: 1188-1195) and Wang et al. (Plast. Reconstr Surg 2003; 111: 1980-7) investigated the inhibition hsp47 expression by RNA interference technology.

In one embodiment, nucleic acid molecules may be used to down regulate or inhibit the expression of hsp47 and/or hsp47 proteins arising from hsp47 and/or hsp47 haplotype polymorphisms that are associated with a disease or condition, (e.g., fibrosis). Analysis of hsp47 and/or hsp47 genes, or hsp47 and/or hsp47 protein or RNA levels can be used to identify subjects with such polymorphisms or those subjects who are at risk of developing traits, conditions, or diseases described herein. These subjects are amenable to treatment, for example, treatment with nucleic acid molecules disclosed herein and any other composition useful in treating diseases related to hsp47 and/or hsp47 gene expression. As such, analysis of hsp47 and/or hsp47 protein or RNA levels can be used to determine treatment type and the course of therapy in treating a subject. Monitoring of hsp47 and/or hsp47 protein or RNA levels can be used to predict treatment outcome and to determine the efficacy of compounds and compositions that modulate the level and/or activity of certain hsp47 and/or hsp47 proteins associated with a trait, condition, or disease.

Provided are compositions and methods for inhibition of hsp47 expression by using small nucleic acid molecules as provided herein, such as short interfering nucleic acid (siNA), interfering RNA (RNAi), short interfering RNA (siRNA), double-stranded RNA (dsRNA), micro-RNA (miRNA), and short hairpin RNA (shRNA) molecules capable of mediating or that mediate RNA interference against hsp47 gene expression. The composition and methods disclosed herein are also useful in treating various fibrosis such as liver fibrosis, lung fibrosis, and kidney fibrosis.

The nucleic acid molecules disclosed herein individually, or in combination or in conjunction with other drugs, can be use for preventing or treating diseases, traits, conditions and/or disorders associated with hsp47, such as liver fibrosis, cirrhosis, pulmonary fibrosis, kidney fibrosis, peritoneal fibrosis, chronic hepatic damage, and fibrillogenesis.

The nucleic acid molecules disclosed herein are able to inhibit the expression of hsp47 in a sequence specific manner. The nucleic acid molecules may include a sense strand and an antisense strand which include contiguous nucleotides that are at least partially complementary (antisense) to a hsp47 mRNA.

In some embodiments, dsRNA specific for hsp47 can be used in conjunction with other dsRNA specific for other molecular chaperones that assist in the folding of newly synthesized proteins such as, calnexin, calreticulin, BiP (Bergeron et al. Trends Biochem. Sci. 1994; 19:124-128; Herbert et al. 1995; Cold Spring Harb. Symp. Quant. Biol. 60:405-415)

Fibrosis can be treated by RNA interference using nucleic acid molecules as disclosed herein. Exemplary fibrosis include liver fibrosis, peritoneal fibrosis, lung fibrosis, kidney fibrosis. The nucleic acid molecules disclosed herein may inhibit the expression of hsp47 in a sequence specific manner.

Treatment of fibrosis can be monitored by determining the level of extracellular collagen using suitable techniques known in the art such as, using anti-collagen I antibodies. Treatment can also be monitored by determining the level of hsp47 mRNA or the level of HSP47 protein in the cells of the affected tissue. Treatment can also be monitored by non-invasive scanning of the affected organ or tissue such as by computer assisted tomography scan, magnetic resonance elastography scans.

A method for treating or preventing hsp47 associated disease or condition in a subject or organism may include contacting the subject or organism with a nucleic acid molecule as provided herein under conditions suitable to modulate the expression of the hsp47 gene in the subject or organism.

A method for treating or preventing fibrosis in a subject or organism may include contacting the subject or organism with a nucleic acid molecule under conditions suitable to modulate the expression of the hsp47 gene in the subject or organism.

A method for treating or preventing one or more fibroses selected from the group consisting of liver fibrosis, kidney fibrosis, and pulmonary fibrosis in a subject or organism may include contacting the subject or organism with a nucleic acid molecule under conditions suitable to modulate the expression of the hsp47 gene in the subject or organism.

Fibrotic Diseases

Fibrotic diseases are generally characterized by the excess deposition of a fibrous material within the extracellular matrix, which contributes to abnormal changes in tissue architecture and interferes with normal organ function.

All tissues damaged by trauma respond by the initiation of a wound-healing program. Fibrosis, a type of disorder characterized by excessive scarring, occurs when the normal self-limiting process of wound healing response is disturbed, and causes excessive production and deposition of collagen. As a result, normal organ tissue is replaced with scar tissue, which eventually leads to the functional failure of the organ.

Fibrosis may be initiated by diverse causes and in various organs. Liver cirrhosis, pulmonary fibrosis, sarcoidosis, keloids and kidney fibrosis are all chronic conditions associated with progressive fibrosis, thereby causing a continuous loss of normal tissue function.

Acute fibrosis (usually with a sudden and severe onset and of short duration) occurs as a common response to various forms of trauma including accidental injuries (particularly injuries to the spine and central nervous system), infections, surgery, ischemic illness (e.g. cardiac scarring following heart attack), burns, environmental pollutants, alcohol and other types of toxins, acute respiratory distress syndrome, radiation and chemotherapy treatments).

Fibrosis, a fibrosis related pathology or a pathology related to aberrant crosslinking of cellular proteins may all be treated by the siRNAs disclosed herein. Fibrotic diseases or diseases in which fibrosis is evident (fibrosis related pathology) include both acute and chronic forms of fibrosis of organs, including all etiological variants of the following: pulmonary fibrosis, including interstitial lung disease and fibrotic lung disease, liver fibrosis, cardiac fibrosis including myocardial fibrosis, kidney fibrosis including chronic renal failure, skin fibrosis including scleroderma, keloids and hypertrophic scars; myelofibrosis (bone marrow fibrosis); all types of ocular scarring including proliferative vitreoretinopathy (PVR) and scarring resulting from surgery to treat cataract or glaucoma; inflammatory bowel disease of variable etiology, macular degeneration, Grave's ophthalmopathy, drug induced ergotism, keloid scars, scleroderma, psoriasis, glioblastoma in Li-Fraumeni syndrome, sporadic glioblastoma, myleoid leukemia, acute myelogenous leukemia, myelodysplastic syndrome, myeloproferative syndrome, gynecological cancer, Kaposi's sarcoma, Hansen's disease, and collagenous colitis.

In various embodiments, the compounds (nucleic acid molecules) as disclosed herein may be used to treat fibrotic diseases, for example as disclosed herein, as well as many other diseases and conditions apart from fibrotic diseases, for example such as disclosed herein. Other conditions to be treated include fibrotic diseases in other organs—kidney fibrosis for any reason (CKD including ESRD); lung fibrosis (including ILF); myelofibrosis, abnormal scarring (keloids) associated with all possible types of skin injury accidental and jatrogenic (operations); scleroderma; cardiofibrosis, failure of glaucoma filtering operation; intestinal adhesions.

Ocular Surgery and Fibrotic Complications

Contracture of scar tissue resulting from eye surgery may often occur. Glaucoma surgery to create new drainage channels often fails due to scarring and contraction of tissues and the generated drainage system may be blocked requiring additional surgical intervention. Current anti-scarring regimens (Mitomycin C or 5FU) are limited due to the complications involved (e.g. blindness) e.g. see Cordeiro M F, et al., Human anti-transforming growth factor-beta2 antibody: a new glaucoma anti-scarring agent Invest Ophthalmol V is Sci. 1999 September; 40 (10):2225-34. There may also be contraction of scar tissue formed after corneal trauma or corneal surgery, for example laser or surgical treatment for myopia or refractive error in which contraction of tissues may lead to inaccurate results. Scar tissue may be formed on/in the vitreous humor or the retina, for example, and may eventually causes blindness in some diabetics, and may be formed after detachment surgery, called proliferative vitreoretinopathy (PVR). PVR is the most common complication following retinal detachment and is associated with a retinal hole or break. PVR refers to the growth of cellular membranes within the vitreous cavity and on the front and back surfaces of the retina containing retinal pigment epithelial (RPE) cells. These membranes, which are essentially scar tissues, exert traction on the retina and may result in recurrences of retinal detachment, even after an initially successful retinal detachment procedure.

Scar tissue may be formed in the orbit or on eye and eyelid muscles after squint, orbital or eyelid surgery, or thyroid eye disease, and where scarring of the conjunctiva occurs as may happen after glaucoma surgery or in cicatricial disease, inflammatory disease, for example, pemphigoid, or infective disease, for example, trachoma. A further eye problem associated with the contraction of collagen-including tissues is the opacification and contracture of the lens capsule after cataract extraction. Important role for MMPs has been recognized in ocular diseases including wound healing, dry eye, sterile corneal ulceration, recurrent epithelial erosion, corneal neovascularization, pterygium, conjuctivochalasis, glaucoma, PVR, and ocular fibrosis.

Liver Fibrosis

Liver fibrosis (LF) is a generally irreversible consequence of hepatic damage of several etiologies. In the Western world, the main etiologic categories are: alcoholic liver disease (30-50%), viral hepatitis (30%), biliary disease (5-10%), primary hemochromatosis (5%), and drug-related and cryptogenic cirrhosis of, unknown etiology, (10-15%). Wilson's disease, $\alpha_1$-antitrypsin deficiency and other rare diseases also have liver fibrosis as one of the symptoms. Liver cirrhosis, the end stage of liver fibrosis, frequently requires liver transplantation and is among the top ten causes of death in the Western world.

Kidney Fibrosis and Related Conditions.

Chronic Renal Failure (CRF)

Chronic renal failure is a gradual and progressive loss of the ability of the kidneys to excrete wastes, concentrate urine, and conserve electrolytes. CRF is slowly progressive. It most often results from any disease that causes gradual loss of kidney function, and fibrosis is the main pathology that produces CRF.

Diabetic Nephropathy

Diabetic nephropathy, hallmarks of which are glomerulosclerosis and tubulointerstitial fibrosis, is the single most prevalent cause of end-stage renal disease in the modern world, and diabetic patients constitute the largest population on dialysis. Such therapy is costly and far from optimal. Transplantation offers a better outcome but suffers from a severe shortage of donors.

Chronic Kidney Disease

Chronic kidney disease (CKD) is a worldwide public health problem and is recognized as a common condition that is associated with an increased risk of cardiovascular disease and chronic renal failure (CRF).

The Kidney Disease Outcomes Quality Initiative (K/DOQI) of the National Kidney Foundation (NKF) defines chronic kidney disease as either kidney damage or a decreased kidney glomerular filtration rate (GFR) for three or more months. Other markers of CKD are also known and used for diagnosis. In general, the destruction of renal mass with irreversible sclerosis and loss of nephrons leads to a progressive decline in GFR. Recently, the K/DOQI published a classification of the stages of CKD, as follows:

Stage 1: Kidney damage with normal or increased GFR (>90 mL/min/1.73 m2)
Stage 2: Mild reduction in GFR (60-89 mL/min/1.73 m2)
Stage 3: Moderate reduction in GFR (30-59 mL/min./1.73 m2)
Stage 4: Severe reduction in GFR (15-29 mL/min/1.73 m2)
Stage 5: Kidney failure (GFR<15 mL/min/1.73 m2 or dialysis)

In stages 1 and 2 CKD, GFR alone does not confirm the diagnosis. Other markers of kidney damage, including abnormalities in the composition of blood or urine or abnormalities in imaging tests, may be relied upon.

Pathophysiology of CKD

Approximately 1 million nephrons are present in each kidney, each contributing to the total GFR. Irrespective of the etiology of renal injury, with progressive destruction of nephrons, the kidney is able to maintain GFR by hyperfiltration and compensatory hypertrophy of the remaining healthy nephrons. This nephron adaptability allows for continued normal clearance of plasma solutes so that substances such as urea and creatinine start to show significant increases in plasma levels only after total GFR has decreased to 50%, when the renal reserve has been exhausted. The plasma creatinine value will approximately double with a 50% reduction in GFR. Therefore, a doubling in plasma creatinine from a baseline value of 0.6 mg/dL to 1.2 mg/dL in a patient actually represents a loss of 50% of functioning nephron mass.

The residual nephron hyperfiltration and hypertrophy, although beneficial for the reasons noted, is thought to represent a major cause of progressive renal dysfunction. This is believed to occur because of increased glomerular capillary pressure, which damages the capillaries and leads initially to focal and segmental glomerulosclerosis and eventually to global glomerulosclerosis. This hypothesis has been based on studies of five-sixths nephrectomized rats, which develop lesions that are identical to those observed in humans with CKD.

The two most common causes of chronic kidney disease are diabetes and hypertension. Other factors include acute insults from nephrotoxins, including contrasting agents, or decreased perfusion; Proteinuria; Increased renal ammoniagenesis with interstitial injury; Hyperlipidemia; Hyperphosphatemia with calcium phosphate deposition; Decreased levels of nitrous oxide and smoking.

In the United States, the incidence and prevalence of CKD is rising, with poor outcomes and high cost to the health system. Kidney disease is the ninth leading cause of death in the US. The high rate of mortality has led the US Surgeon General's mandate for America's citizenry, Healthy People 2010, to contain a chapter focused on CKD. The objectives of this chapter are to articulate goals and to provide strategies to reduce the incidence, morbidity, mortality, and health costs of chronic kidney disease in the United States.

The incidence rates of end-stage renal disease (ESRD) have also increased steadily internationally since 1989. The United States has the highest incident rate of ESRD, followed by Japan. Japan has the highest prevalence per million population, followed by the US.

The mortality rates associated with hemodialysis are striking and indicate that the life expectancy of patients entering into hemodialysis is markedly shortened. At every age, patients with ESRD on dialysis have significantly increased mortality when compared with nondialysis patients and individuals without kidney disease. At age 60 years, a healthy person can expect to live for more than 20 years, whereas the life expectancy of a 60-year-old patient starting hemodialysis is closer to 4 years (Aurora and Verelli, May 21, 2009.

Chronic Renal Failure: Treatment & Medication. Emedicine. http://emedicine.medscape.com/article/238798-treatment).

Pulmonary Fibrosis

Interstitial pulmonary fibrosis (IPF) is scarring of the lung caused by a variety of inhaled agents including mineral particles, organic dusts, and oxidant gases, or by unknown reasons (idiopathic lung fibrosis). The disease afflicts millions of individuals worldwide, and there are no effective therapeutic approaches. A major reason for the lack of useful treatments is that few of the molecular mechanisms of disease have been defined sufficiently to design appropriate targets for therapy (Lasky J A., Brody A R. (2000), "Interstitial fibrosis and growth factors", Environ Health Perspect.; 108 Suppl 4:751-62).

Cardiac Fibrosis

Heart failure is unique among the major cardiovascular disorders in that it alone is increasing in prevalence while there has been a striking decrease in other conditions. Some of this can be attributed to the aging of the populations of the United States and Europe. The ability to salvage patients with myocardial damage is also a major factor, as these patients may develop progression of left ventricular dysfunction due to deleterious remodelling of the heart.

The normal myocardium is composed of a variety of cells, cardiac myocytes and noncardiomyocytes, which include endothelial and vascular smooth muscle cells and fibroblasts.

Structural remodeling of the ventricular wall is a key determinant of clinical outcome in heart disease. Such remodeling involves the production and destruction of extracellular matrix proteins, cell proliferation and migration, and apoptotic and necrotic cell death. Cardiac fibroblasts are crucially involved in these processes, producing growth factors and cytokines that act as autocrine and paracrine factors, as well as extracellular matrix proteins and proteinases. Recent studies have shown that the interactions between cardiac fibroblasts and cardiomyocytes are essential for the progression of cardiac remodeling of which the net effect is deterioration in cardiac function and the onset of heart failure (Manabe I, et al., (2002), "Gene expression in fibroblasts and fibrosis: involvement in cardiac hypertrophy", Circ Res. 13; 91 (12): 1103-13).

Burns and Scars

A particular problem which may arise, particularly in fibrotic disease, is contraction of tissues, for example contraction of scars. Contraction of tissues including extracellular matrix components, especially of collagen-including tissues, may occur in connection with many different pathological conditions and with surgical or cosmetic procedures. Contracture, for example, of scars, may cause physical problems, which may lead to the need for medical treatment, or it may cause problems of a purely cosmetic nature. Collagen is the major component of scar and other contracted tissue and as such is the most important structural component to consider. Nevertheless, scar and other contracted tissue also includes other structural components, especially other extracellular matrix components, for example, elastin, which may also contribute to contraction of the tissue.

Contraction of collagen-including tissue, which may also include other extracellular matrix components, frequently occurs in the healing of burns. The burns may be chemical, thermal or radiation burns and may be of the eye, the surface of the skin or the skin and the underlying tissues. It may also be the case that there are burns on internal tissues, for example, caused by radiation treatment. Contraction of burnt tissues is often a problem and may lead to physical and/or cosmetic problems, for example, loss of movement and/or disfigurement.

Skin grafts may be applied for a variety of reasons and may often undergo contraction after application. As with the healing of burnt tissues the contraction may lead to both physical and cosmetic problems. It is a particularly serious problem where many skin grafts are needed as, for example, in a serious burns case.

Contraction is also a problem in production of artificial skin. To make a true artificial skin it is necessary to have an epidermis made of epithelial cells (keratinocytes) and a dermis made of collagen populated with fibroblasts. It is important to have both types of cells because they signal and stimulate each other using growth factors. The collagen component of the artificial skin often contracts to less than one tenth of its original area when populated by fibroblasts.

Cicatricial contraction, contraction due to shrinkage of the fibrous tissue of a scar, is common. In some cases the scar may become a vicious cicatrix, a scar in which the contraction causes serious deformity. A patient's stomach may be effectively separated into two separate chambers in an hour-glass contracture by the contraction of scar tissue formed when a stomach ulcer heals. Obstruction of passages and ducts, cicatricial stenosis, may occur due to the contraction of scar tissue. Contraction of blood vessels may be due to primary obstruction or surgical trauma, for example, after surgery or angioplasty. Stenosis of other hollow visci, for examples, ureters, may also occur. Problems may occur where any form of scarring takes place, whether resulting from accidental wounds or from surgery. Conditions of the skin and tendons which involve contraction of collagen-including tissues include post-trauma conditions resulting from surgery or accidents, for example, hand or foot tendon injuries, post-graft conditions and pathological conditions, such as scleroderma, Dupuytren's contracture and epidermolysis bullosa. Scarring and contraction of tissues in the eye may occur in various conditions, for example, the sequelae of retinal detachment or diabetic eye disease (as mentioned above). Contraction of the sockets found in the skull for the eyeballs and associated structures, including extra-ocular muscles and eyelids, may occur if there is trauma or inflammatory damage. The tissues contract within the sockets causing a variety of problems including double vision and an unsightly appearance.

For further information on different types of fibrosis see: Molina V, et al., (2002), "Fibrotic diseases", Harefuah, 141 (11): 973-8, 1009; Yu L, et al., (2002), "Therapeutic strategies to halt renal fibrosis", Curr Opin Pharmacol. 2 (2):177-81; Keane W F and Lyle P A. (2003), "Recent advances in management of type 2 diabetes and nephropathy: lessons from the RENAAL study", Am J Kidney Dis. 41 (3 Suppl 2): S22-5; Bohle A, et al., (1989), "The pathogenesis of chronic renal failure", Pathol Res Pract. 185 (4):421-40; Kikkawa R, et al., (1997), "Mechanism of the progression of diabetic nephropathy to renal failure", Kidney Int Suppl. 62:S39-40; Bataller R, and Brenner D A. (2001), "Hepatic stellate cells as a target for the treatment of liver fibrosis", Semin Liver Dis. 21 (3):437-51; Gross T J and Hunninghake G W, (2001) "Idiopathic pulmonary fibrosis", N Engl J. Med. 345 (7):517-25; Frohlich E D. (2001) "Fibrosis and ischemia: the real risks in hypertensive heart disease", Am J Hypertens; 14 (6 Pt 2):194S-199S; Friedman S L. (2003), "Liver fibrosis—from bench to bedside", J. Hepatol. 38 Suppl 1:S38-53; Albanis E, et al., (2003), "Treatment of hepatic fibrosis: almost there", Curr Gastroenterol Rep. 5 (1):48-56; (Weber K T. (2000), "Fibrosis and hypertensive heart disease", Curr Opin Cardiol. 15 (4):264-72).

Delivery of Nucleic Acid Molecules and Pharmaceutical Formulations

Nucleic acid molecules may be adapted for use to prevent or treat fibroses (e.g., liver, kidney, peritoneal, and pulmonary) diseases, traits, conditions and/or disorders, and/or any other trait, disease, disorder or condition that is related to or will respond to the levels of hsp47 in a cell or tissue, alone or in combination with other therapies. A nucleic acid molecule may include a delivery vehicle, including liposomes, for administration to a subject, carriers and diluents and their salts, and/or can be present in pharmaceutically acceptable formulations.

Nucleic acid molecules disclosed herein may be delivered or administered directly with a carrier or diluent but not any delivery vehicle that acts to assist, promote or facilitate entry to the cell, including viral vectors, viral particles, liposome formulations, lipofectin or precipitating agents and the like.

Nucleic acid molecules may be delivered or administered to a subject by direct application of the nucleic acid molecules with a carrier or diluent or any other delivery vehicle that acts to assist, promote or facilitate entry into a cell, including viral sequences, viral particular, liposome formulations, lipofectin or precipitating agents and the like. Polypeptides that facilitate introduction of nucleic acid into a desired subject such as those described in US. Application Publication No. 20070155658 (e.g., a melamine derivative such as 2,4,6-Triguanidino Traizine and 2,4,6-Tramidosarcocyl Melamine, a polyarginine polypeptide, and a polypeptide including alternating glutamine and asparagine residues).

Methods for the delivery of nucleic acid molecules are described in Akhtar et al., Trends Cell Bio., 2: 139 (1992); Delivery Strategies for Antisense Oligonucleotide Therapeutics, ed. Akhtar, (1995), Maurer et al., Mol. Membr. Biol., 16: 129-140 (1999); Hofland and Huang, Handb. Exp. Pharmacol., 137: 165-192 (1999); and Lee et al., ACS Symp. Ser., 752: 184-192 (2000); U.S. Pat. Nos. 6,395,713; 6,235,310; 5,225,182; 5,169,383; 5,167,616; 4,959217; 4,925,678; 4,487,603; and 4,486,194 and Sullivan et al., PCT WO 94/02595; PCT WO 00/03683 and PCT WO 02/08754; and U.S. Patent Application Publication No. 2003077829. These protocols can be utilized for the delivery of virtually any nucleic acid molecule. Nucleic acid molecules can be administered to cells by a variety of methods known to those of skill in the art, including, but not restricted to, encapsulation in liposomes, by iontophoresis, or by incorporation into other vehicles, such as biodegradable polymers, hydrogels, cyclodextrins (see e.g., Gonzalez et al., Bioconjugate Chem., 10: 1068-1074 (1999); Wang et al., International PCT publication Nos. WO 03/47518 and WO 03/46185), poly(lactic-co-glycolic)acid (PLGA) and PLCA microspheres (see for example U.S. Pat. No. 6,447,796 and U.S. Application Publication No. 2002130430), biodegradable nanocapsules, and bioadhesive microspheres, or by proteinaceous vectors (O'Hare and Normand, International PCT Publication No. WO 00/53722). Alternatively, the nucleic acid/vehicle combination is locally delivered by direct injection or by use of an infusion pump. Direct injection of the nucleic acid molecules of the invention, whether subcutaneous, intramuscular, or intradermal, can take place using standard needle and syringe methodologies, or by needle-free technologies such as those described in Conry et al., Clin. Cancer Res., 5: 2330-2337 (1999) and Barry et al., International PCT Publication No. WO 99/31262. The molecules of the instant invention can be used as pharmaceutical agents. Pharmaceutical agents prevent, modulate the occurrence, or treat (alleviate a symptom to some extent, preferably all of the symptoms) of a disease state in a subject.

Nucleic acid molecules may be complexed with cationic lipids, packaged within liposomes, or otherwise delivered to target cells or tissues. The nucleic acid or nucleic acid complexes can be locally administered to relevant tissues ex vivo, or in vivo through direct dermal application, transdermal application, or injection, with or without their incorporation in biopolymers. The nucleic acid molecules of the invention may include sequences shown in Tables I. Examples of such nucleic acid molecules consist essentially of sequences provided in Table I.

Delivery systems include surface-modified liposomes containing poly(ethylene glycol) lipids (PEG-modified, or long-circulating liposomes or stealth liposomes). These formulations offer a method for increasing the accumulation of drugs in target tissues. This class of drug carriers resists opsonization and elimination by the mononuclear phagocytic system (MPS or RES), thereby enabling longer blood circulation times and enhanced tissue exposure for the encapsulated drug (Lasic et al. Chem. Rev. 1995, 95, 2601-2627; Ishiwata et al., Chem. Pharm. Bull. 1995, 43, 1005-1011).

Nucleic acid molecules may be formulated or complexed with polyethylenimine (e.g., linear or branched PEI) and/or polyethylenimine derivatives, including for example polyethyleneimine-polyethyleneglycol-N-acetylgalactosamine (PEI-PEG-GAL) or polyethyleneimine-polyethyleneglycol-tri-N-acetylgalactosamine (PEI-PEG-triGAL) derivatives, grafted PEIs such as galactose PEI, cholesterol PEI, antibody derivatized PEI, and polyethylene glycol PEI (PEG-PEI) derivatives thereof (see for example Ogris et al., 2001, AAPA PharmSci, 3, 1-11; Furgeson et al., 2003, Bioconjugate Chem., 14, 840-847; Kunath et al., 2002, Pharmaceutical Research, 19, 810-817; Choi et al, 2001, Bull. Korean Chem. Soc., 22, 46-52; Bettinger et al., 1999, Bioconjugate Chem., 10, 558-561; Peterson et al., 2002, Bioconjugate Chem., 13, 845-854; Erbacher et al., 1999, Journal of Gene Medicine Preprint, 1, 1-18; Godbey et al., 1999, PNAS USA, 96, 5177-5181; Godbey et al., 1999, Journal of Controlled Release, 60, 149-160; Diebold et al., 1999, Journal of Biological Chemistry, 274, 19087-19094; Thomas and Klibanov, 2002, PNAS USA, 99, 14640-14645; Sagara, U.S. Pat. No. 6,586,524 and United States Patent Application Publication No. 20030077829.

Nucleic acid molecules may be complexed with membrane disruptive agents such as those described in U.S. Patent Application Publication No. 20010007666. The membrane disruptive agent or agents and the nucleic acid molecule may also be complexed with a cationic lipid or helper lipid molecule, such as those lipids described in U.S. Pat. No. 6,235, 310.

The nucleic acid molecules may be administered via pulmonary delivery, such as by inhalation of an aerosol or spray dried formulation administered by an inhalation device or nebulizer, providing rapid local uptake of the nucleic acid molecules into relevant pulmonary tissues. Solid particulate compositions containing respirable dry particles of micronized nucleic acid compositions can be prepared by grinding dried or lyophilized nucleic acid compositions, and then passing the micronized composition through, for example, a 400 mesh screen to break up or separate out large agglomerates. A solid particulate composition comprising the nucleic acid compositions of the invention can optionally contain a dispersant which serves to facilitate the formation of an aerosol as well as other therapeutic compounds. A suitable dispersant is lactose, which can be blended with the nucleic acid compound in any suitable ratio, such as a 1 to 1 ratio by weight.

Aerosols of liquid particles may include a nucleic acid molecules disclosed herein and can be produced by any suitable means, such as with a nebulizer (see e.g., U.S. Pat. No. 4,501,729). Nebulizers are commercially available devices which transform solutions or suspensions of an active ingredient into a therapeutic aerosol mist either by means of acceleration of a compressed gas, typically air or oxygen, through a narrow venturi orifice or by means of ultrasonic agitation. Suitable formulations for use in nebulizers include the active ingredient in a liquid carrier in an amount of up to 40% w/w preferably less than 20% w/w of the formulation. The carrier is typically water or a dilute aqueous alcoholic solution, preferably made isotonic with body fluids by the addition of, e.g., sodium chloride or other suitable salts. Optional additives include preservatives if the formulation is not prepared sterile, e.g., methyl hydroxybenzoate, anti-oxidants, flavorings, volatile oils, buffering agents and emulsifiers and other formulation surfactants. The aerosols of solid particles including the active composition and surfactant can likewise be produced with any solid particulate aerosol generator. Aerosol generators for administering solid particulate therapeutics to a subject produce particles which are respirable, as explained above, and generate a volume of aerosol containing a predetermined metered dose of a therapeutic composition at a rate suitable for human administration. One illustrative type of solid particulate aerosol generator is an insufflator. Suitable formulations for administration by insufflation include finely comminuted powders which can be delivered by means of an insufflator. In the insufflator, the powder, e.g., a metered dose thereof effective to carry out the treatments described herein, is contained in capsules or cartridges, typically made of gelatin or plastic, which are either pierced or opened in situ and the powder delivered by air drawn through the device upon inhalation or by means of a manually-operated pump. The powder employed in the insufflator consists either solely of the active ingredient or of a powder blend comprising the active ingredient, a suitable powder diluent, such as lactose, and an optional surfactant. The active ingredient typically includes from 0.1 to 100 w/w of the formulation. A second type of illustrative aerosol generator includes a metered dose inhaler. Metered dose inhalers are pressurized aerosol dispensers, typically containing a suspension or solution formulation of the active ingredient in a liquefied propellant. During use these devices discharge the formulation through a valve adapted to deliver a metered volume to produce a fine particle spray containing the active ingredient. Suitable propellants include certain chlorofluorocarbon compounds, e.g., dichlorodifluoromethane, trichlorofluoromethane, dichlorotetrafluoroethane and mixtures thereof. The formulation can additionally contain one or more co-solvents, for example, ethanol, emulsifiers and other formulation surfactants, such as oleic acid or sorbitan trioleate, anti-oxidants and suitable flavoring agents. Other methods for pulmonary delivery are described in, e.g., US Patent Application No. 20040037780, and U.S. Pat. Nos. 6,592,904; 6,582,728; 6,565,885. PCT Patent Publication No. WO2008/132723 relates to aerosol delivery of oligonucleotides in general, and of siRNA in particular, to the respiratory system.

Nucleic acid molecules may be administered to the central nervous system (CNS) or peripheral nervous system (PNS). Experiments have demonstrated the efficient in vivo uptake of nucleic acids by neurons. See e.g., Sommer et al., 1998, Antisense Nuc. Acid Drug Dev., 8, 75; Epa et al., 2000, Antisense Nuc. Acid Drug Dev., 10, 469; Broaddus et al., 1998, J. Neurosurg., 88(4), 734; Karle et al., 1997, Eur. J. Pharmacol., 340 (2/3), 153; Bannai et al., 1998, Brain Research, 784 (1,2), 304; Rajakumar et al., 1997, Synapse, 26(3), 199; Wu-pong et al., 1999, BioPharm, 12 (1), 32; Bannai et al., 1998, Brain Res. Protoc., 3 (1), 83; and Simantov et al., 1996, Neuroscience, 74 (1), 39. Nucleic acid molecules are therefore amenable to delivery to and uptake by cells in the CNS and/or PNS.

Delivery of nucleic acid molecules to the CNS is provided by a variety of different strategies. Traditional approaches to CNS delivery that can be used include, but are not limited to, intrathecal and intracerebroventricular administration, implantation of catheters and pumps, direct injection or perfusion at the site of injury or lesion, injection into the brain arterial system, or by chemical or osmotic opening of the blood-brain barrier. Other approaches can include the use of various transport and carrier systems, for example though the use of conjugates and biodegradable polymers. Furthermore, gene therapy approaches, e.g., as described in Kaplitt et al., U.S. Pat. No. 6,180,613 and Davidson, WO 04/013280, can be used to express nucleic acid molecules in the CNS.

Delivery systems may include, for example, aqueous and nonaqueous gels, creams, multiple emulsions, microemulsions, liposomes, ointments, aqueous and nonaqueous solutions, lotions, aerosols, hydrocarbon bases and powders, and can contain excipients such as solubilizers, permeation enhancers (e.g., fatty acids, fatty acid esters, fatty alcohols and amino acids), and hydrophilic polymers (e.g., polycarbophil and polyvinylpyrolidone). In one embodiment, the pharmaceutically acceptable carrier is a liposome or a transdermal enhancer. Examples of liposomes which can be used in this invention include the following: (1) CellFectin, 1:1.5 (M/M) liposome formulation of the cationic lipid N,NI,NII,NIII-tetramethyl-N,NI,NII,NIII-tetrapalmit-y-spermine and dioleoyl phosphatidylethanolamine (DOPE) (GIBCO BRL); (2) Cytofectin GSV, 2:1 (M/M) liposome formulation of a cationic lipid and DOPE (Glen Research); (3) DOTAP (N-[1-(2, 3-dioleoyloxy)-N,N,N-tri-methyl-ammoniummethylsulfate) (Boehringer Manheim); and (4) Lipofectamine, 3:1 (M/M) liposome formulation of the polycationic lipid DOSPA, the neutral lipid DOPE (GIBCO BRL) and Di-Alkylated Amino Acid (DiLA2).

Delivery systems may include patches, tablets, suppositories, pessaries, gels and creams, and can contain excipients such as solubilizers and enhancers (e.g., propylene glycol, bile salts and amino acids), and other vehicles (e.g., polyethylene glycol, fatty acid esters and derivatives, and hydrophilic polymers such as hydroxypropylmethylcellulose and hyaluronic acid).

Nucleic acid molecules may be formulated or complexed with polyethylenimine (e.g., linear or branched PEI) and/or polyethylenimine derivatives, including for example grafted PEIs such as galactose PEI, cholesterol PEI, antibody derivatized PEI, and polyethylene glycol PEI (PEG-PEI) derivatives thereof (see for example Ogris et al., 2001, AAPA PharmSci, 3, 1-11; Furgeson et al., 2003, Bioconjugate Chem., 14, 840-847; Kunath et al., 2002, Pharmaceutical Research, 19, 810-817; Choi et al., 2001, Bull. Korean Chem. Soc., 22, 46-52; Bettinger et al., 1999, Bioconjugate Chem., 10, 558-561; Peterson et al., 2002, Bioconjugate Chem., 13, 845-854; Erbacher et al., 1999, Journal of Gene Medicine Preprint, 1, 1-18; Godbey et al., 1999., PNAS USA, 96, 5177-5181; Godbey et al., 1999, Journal of Controlled Release, 60, 149-160; Diebold et al., 1999, Journal of Biological Chemistry, 274, 19087-19094; Thomas and Klibanov, 2002, PNAS USA, 99, 14640-14645; and Sagara, U.S. Pat. No. 6,586,524.

Nucleic acid molecules may include a bioconjugate, for example a nucleic acid conjugate as described in Vargeese et al., U.S. Ser. No. 10/427,160; U.S. Pat. No. 6,528,631; U.S. Pat. No. 6,335,434; U.S. Pat. No. 6,235,886; U.S. Pat. No. 6,153,737; U.S. Pat. No. 5,214,136; U.S. Pat. No. 5,138,045.

Compositions, methods and kits disclosed herein may include an expression vector that includes a nucleic acid sequence encoding at least one nucleic acid molecule of the invention in a manner that allows expression of the nucleic acid molecule. Methods of introducing nucleic acid molecules or one or more vectors capable of expressing the strands of dsRNA into the environment of the cell will depend on the type of cell and the make up of its environment. The nucleic acid molecule or the vector construct may be directly introduced into the cell (i.e., intracellularly); or introduced extracellularly into a cavity, interstitial space, into the circulation of an organism, introduced orally, or may be introduced by bathing an organism or a cell in a solution containing dsRNA. The cell is preferably a mammalian cell; more preferably a human cell. The nucleic acid molecule of the expression vector can include a sense region and an antisense region. The antisense region can include a sequence complementary to a RNA or DNA sequence encoding hsp47 and the sense region can include a sequence complementary to the antisense region. The nucleic acid molecule can include two distinct strands having complementary sense and antisense regions. The nucleic acid molecule can include a single strand having complementary sense and antisense regions.

Nucleic acid molecules that interact with target RNA molecules and down-regulate gene encoding target RNA molecules (e.g., target RNA molecules referred to by Genbank Accession numbers herein) may be expressed from transcription units inserted into DNA or RNA vectors. Recombinant vectors can be DNA plasmids or viral vectors. Nucleic acid molecule expressing viral vectors can be constructed based on, but not limited to, adeno-associated virus, retrovirus, adenovirus, or alphavirus. The recombinant vectors capable of expressing the nucleic acid molecules can be delivered as described herein, and persist in target cells. Alternatively, viral vectors can be used that provide for transient expression of nucleic acid molecules. Such vectors can be repeatedly administered as necessary. Once expressed, the nucleic acid molecules bind and down-regulate gene function or expression via RNA interference (RNAi). Delivery of nucleic acid molecule expressing vectors can be systemic, such as by intravenous or intramuscular administration, by administration to target cells ex-planted from a subject followed by reintroduction into the subject, or by any other means that would allow for introduction into the desired target cell.

Expression vectors may include a nucleic acid sequence encoding at least one nucleic acid molecule disclosed herein, in a manner which allows expression of the nucleic acid molecule. For example, the vector may contain sequence(s) encoding both strands of a nucleic acid molecule that include a duplex. The vector can also contain sequence(s) encoding a single nucleic acid molecule that is self-complementary and thus forms a nucleic acid molecule. Non-limiting examples of such expression vectors are described in Paul et al., 2002, Nature Biotechnology, 19, 505; Miyagishi and Taira, 2002, Nature Biotechnology, 19, 497; Lee et al., 2002, Nature Biotechnology, 19, 500; and Novina et al., 2002, Nature Medicine, advance online publication doi:10.1038/nm725. Expression vectors may also be included in a mammalian (e.g., human) cell.

An expression vector may include a nucleic acid sequence encoding two or more nucleic acid molecules, which can be the same or different. Expression vectors may include a sequence for a nucleic acid molecule complementary to a nucleic acid molecule referred to by a Genbank Accession number NM_001235, for example those shown in Table I.

An expression vector may encode one or both strands of a nucleic acid duplex, or a single self-complementary strand that self hybridizes into a nucleic acid duplex. The nucleic acid sequences encoding nucleic acid molecules can be operably linked in a manner that allows expression of the nucleic acid molecule (see for example Paul et al., 2002, Nature Biotechnology, 19, 505; Miyagishi and Taira, 2002, Nature Biotechnology, 19, 497; Lee et al., 2002, Nature Biotechnology, 19, 500; and Novina et al., 2002, Nature Medicine, advance online publication doi:10.1038/nm725).

An expression vector may include one or more of the following: a) a transcription initiation region (e.g., eukaryotic pol I, II or III initiation region); b) a transcription termination region (e.g., eukaryotic pol I, II or III termination region); c) an intron and d) a nucleic acid sequence encoding at least one of the nucleic acid molecules, wherein said sequence is operably linked to the initiation region and the termination region in a manner that allows expression and/or delivery of the nucleic acid molecule. The vector can optionally include an open reading frame (ORF) for a protein operably linked on the 5' side or the 3'-side of the sequence encoding the nucleic acid molecule; and/or an intron (intervening sequences).

Transcription of the nucleic acid molecule sequences can be driven from a promoter for eukaryotic RNA polymerase I (pol I), RNA polymerase II (pol II), or RNA polymerase III (pol III). Transcripts from pol II or pol III promoters are expressed at high levels in all cells; the levels of a given pol II promoter in a given cell type depends on the nature of the gene regulatory sequences (enhancers, silencers, etc.) present nearby. Prokaryotic RNA polymerase promoters are also used, providing that the prokaryotic RNA polymerase enzyme is expressed in the appropriate cells (Elroy-Stein and Moss, 1990, Proc. Natl. Acad. Sci. USA, 87, 6743-7; Gao and Huang 1993, Nucleic Acids Res., 21, 2867-72; Lieber et al., 1993, Methods Enzymol., 217, 47-66; Zhou et al., 1990, Mol. Cell. Biol., 10, 4529-37). Several investigators have demonstrated that nucleic acid molecules expressed from such promoters can function in mammalian cells (e.g. Kashani-Sabet et al., 1992, Antisense Res. Dev., 2, 3-15; Ojwang et al., 1992, Proc. Natl. Acad. Sci. USA, 89, 10802-6; Chen et al., 1992, Nucleic Acids Res., 20, 4581-9; Yu et al., 1993, Proc. Natl. Acad. Sci. USA, 90, 6340-4; L'Huillier et al., 1992, EMBO J., 11, 4411-8; Lisziewicz et al., 1993, Proc. Natl. Acad. Sci. U.S.A, 90, 8000-4; Thompson et al., 1995, Nucleic Acids Res., 23, 2259; Sullenger & Cech, 1993, Science, 262, 1566). More specifically, transcription units such as the ones derived from genes encoding U6 small nuclear (snRNA), transfer RNA (tRNA) and adenovirus VA RNA are useful in generating high concentrations of desired RNA molecules such as siNA in cells (Thompson et al., supra; Couture and Stinchcomb, 1996, supra; Noonberg et al., 1994, Nucleic Acid Res., 22, 2830; Noonberg et al., U.S. Pat. No. 5,624,803; Good et al., 1997, Gene Ther., 4, 45; Beigelman et al., International PCT Publication No. WO 96/18736. The above nucleic acid transcription units can be incorporated into a variety of vectors for introduction into mammalian cells, including but not restricted to, plasmid DNA vectors, viral DNA vectors (such as adenovirus or adeno-associated virus vectors), or viral RNA vectors (such as retroviral or alphavirus vectors) (see Couture and Stinchcomb, 1996 supra).

Nucleic acid molecule may be expressed within cells from eukaryotic promoters (e.g., Izant and Weintraub, 1985, Science, 229, 345; McGarry and Lindquist, 1986, Proc. Natl. Acad. Sci., USA 83, 399; Scanlon et al., 1991, Proc. Natl. Acad. Sci. USA, 88, 10591-5; Kashani-Sabet et al., 1992, Antisense Res. Dev., 2, 3-15; Dropulic et al., 1992, J. Virol., 66, 1432-41; Weerasinghe et al., 1991, J. Virol., 65, 5531-4; Ojwang et al., 1992, Proc. Natl. Acad. Sci. USA, 89, 10802-6; Chen et al., 1992, Nucleic Acids Res. 20, 4581-9; Sarver et al., 1990 Science, 247, 1222-1225; Thompson et al., 1995, Nucleic Acids Res., 23, 2259; Good et al., 1997, Gene Therapy, 4, 45. Those skilled in the art realize that any nucleic acid can be expressed in eukaryotic cells from the appropriate DNA/RNA vector. The activity of such nucleic acids can be augmented by their release from the primary transcript by a enzymatic nucleic acid (Draper et al., PCT WO 93/23569, and Sullivan et al., PCT WO 94/02595; Ohkawa et al., 1992, Nucleic Acids Symp. Ser., 27, 15-6; Taira et al., 1991, Nucleic Acids Res., 19, 5125-30; Ventura et al., 1993, Nucleic Acids Res., 21, 3249-55; Chowrira et al., 1994, J. Biol. Chem., 269, 25856.

A viral construct packaged into a viral particle would accomplish both efficient introduction of an expression construct into the cell and transcription of dsRNA construct encoded by the expression construct.

Methods for oral introduction include direct mixing of RNA with food of the organism, as well as engineered approaches in which a species that is used as food is engineered to express an RNA, then fed to the organism to be affected. Physical methods may be employed to introduce a nucleic acid molecule solution into the cell. Physical methods of introducing nucleic acids include injection of a solution containing the nucleic acid molecule, bombardment by particles covered by the nucleic acid molecule, soaking the cell or organism in a solution of the RNA, or electroporation of cell membranes in the presence of the nucleic acid molecule.

Other methods known in the art for introducing nucleic acids to cells may be used, such as lipid-mediated carrier transport, chemical mediated transport, such as calcium phosphate, and the like. Thus the nucleic acid molecules may be introduced along with components that perform one or more of the following activities: enhance RNA uptake by the cell, promote annealing of the duplex strands, stabilize the annealed strands, or other-wise increase inhibition of the target gene.

The nucleic acid molecules or the vector construct can be introduced into the cell using suitable formulations. One preferable formulation is with a lipid formulation such as in Lipofectamine™ 2000 (Invitrogen, CA, USA), vitamin A coupled liposomes (Sato et al. Nat Biotechnol 2008; 26:431-442, PCT Patent Publication No. WO 2006/068232). Lipid formulations can also be administered to animals such as by intravenous, intramuscular, or intraperitoneal injection, or orally or by inhalation or other methods as are known in the art. When the formulation is suitable for administration into animals such as mammals and more specifically humans, the formulation is also pharmaceutically acceptable. Pharmaceutically acceptable formulations for administering oligonucleotides are known and can be used. In some instances, it may be preferable to formulate dsRNA in a buffer or saline solution and directly inject the formulated dsRNA into cells, as in studies with oocytes. The direct injection of dsRNA duplexes may also be done. For suitable methods of introducing dsRNA see U.S. published patent application No. 2004/0203145, 20070265220 which are incorporated herein by reference.

Polymeric nanocapsules or microcapsules facilitate transport and release of the encapsulated or bound dsRNA into the cell. They include polymeric and monomeric materials, especially including polybutylcyanoacrylate. A summary of materials and fabrication methods has been published (see Kreuter, 1991). The polymeric materials which are formed from monomeric and/or oligomeric precursors in the polymerization/nanoparticle generation step, are per se known from the prior art, as are the molecular weights and molecular weight distribution of the polymeric material which a person skilled in the field of manufacturing nanoparticles may suitably select in accordance with the usual skill.

Nucleic acid moles may be formulated as a microemulsion. A microemulsion is a system of water, oil and amphiphile which is a single optically isotropic and thermodynamically stable liquid solution. Typically microemulsions are prepared by first dispersing an oil in an aqueous surfactant solution and then adding a sufficient amount of a 4th component, generally an intermediate chain-length alcohol to form a transparent system.

Surfactants that may be used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sequioleate (SO750), decaglycerol decaoleate (DA0750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules.

Water Soluble Crosslinked Polymers

Delivery formulations can include water soluble degradable crosslinked polymers that include one or more degradable crosslinking lipid moiety, one or more PEI moiety, and/or one or more mPEG (methyl ether derivative of PEG (methoxypoly(ethylene glycol)).

Degradable lipid moieties preferably include compounds having the following structural motif:

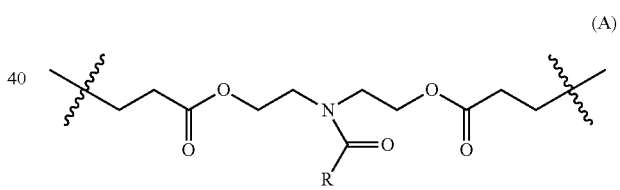

(A)

In the above formula, ester linkages are biodegradable groups, R represents a relatively hydrophobic "lipo" group, and the structural motif shown occurs m times where m is in the range of about 1 to about 30. For example, in certain embodiments R is selected from the group consisting of C2-C50 alkyl, C2-C50 heteroalkyl, C2-C50 alkenyl, C2-C50 heteroalkenyl, C5-C50 aryl; C2-C50 heteroaryl; C2-C50 alkynyl, C2-C50 heteroalkynyl, C2-C50 carboxyalkenyl, and C2-C50 carboxyheteroalkenyl. In preferred embodiments. R is a saturated or unsaturated alkyl having 4 to 30 carbons, more preferably 8 to 24 carbons or a sterol, preferably a cholesteryl moiety. In preferred embodiments, R is oleic, lauric, myristic, palmitic margaric, stearic, arachidic, behenic, or lignoceric. In a most preferred embodiment, R is oleic.

The N in formula (B) may have an electron pair or a bond to a hydrogen atom. When N has an electron pair, the recurring unit may be cationic at low pH.

The degradable crosslinking lipid moiety may be reacted with a polyethyleneimine (PEI) as shown in Scheme A below:

Scheme A

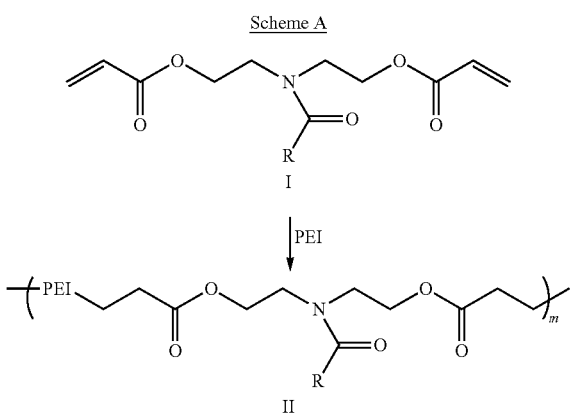

In formula (A), R has the same meanings as described above. The PEI may contain recurring units of formula (B) in which x is an integer in the range of about 1 to about 100 and y is an integer in the range of about 1 to about 100.

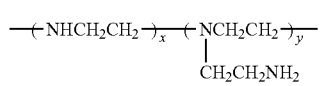

The reaction illustrated in Scheme A may be carried out by intermixing the PEI and the diacrylate (I) in a mutual solvent such as ethanol, methanol or dichloromethane with stirring, preferably at room temperature for several hours, then evaporating the solvent to recover the resulting polymer. While not wishing to be bound to any particular theory, it is believed that the reaction between the PEI and diacrylate (I) involves a Michael reaction between one or more amines of the PEI with double bond(s) of the diacrylate (see J. March, Advanced Organic Chemistry 3rd Ed, pp. 711-712 (1985)). The di acrylate shown in Scheme A may be prepared in the manner as described in U.S. application Ser. No. 11/216,986 (US Publication No. 2006/0258751).

The molecular weight of the PEI is preferably in the range of about 200 to 25,000 Daltons more preferably 400 to 5,000 Daltons, yet more preferably 600 to 2000 Daltons. PEI may be either branched or linear.

The molar ratio of PEI to diacrylate is preferably in the range of about 1:2 to about 1:20. The weight average molecular weight of the cationic lipopolymer may be in the range of about 500 Daltons to about 1,000,000 Daltons preferably in the range of about 2,000 Daltons to about 200.000 Daltons. Molecular weights may be determined by size exclusion chromatography using PEG standards or by agarose gel electrophoresis.

The cationic lipopolymer is preferably degradable, more preferably biodegradable, e.g., degradable by a mechanism selected from the group consisting of hydrolysis, enzyme cleavage, reduction, photo-cleavage, and sonication. While not wishing to be bound to any particular theory, but it is believed that degradation of the cationic lipopolymer of formula (II) within the cell proceeds by enzymatic cleavage and/or hydrolysis of the ester linkages.

Synthesis may be carried out by reacting the degradable lipid moiety with the PEI moiety as described above. Then the mPEG (methyl ether derivative of PEG (methoxypoly (ethylene glycol)), is added to form the degradable crosslinked polymer. In preferred embodiments, the reaction is carried out at room temperature. The reaction products may be isolated by any means known in the art including chromatographic techniques. In a preferred embodiment, the reaction product may be removed by precipitation followed by centrifugation.

Dosages

The useful dosage to be administered and the particular mode of administration will vary depending upon such factors as the cell type, or for in vivo use, the age, weight and the particular animal and region thereof to be treated, the particular nucleic acid and delivery method used, the therapeutic or diagnostic use contemplated, and the form of the formulation, for example, suspension, emulsion, micelle or liposome, as will be readily apparent to those skilled in the art. Typically, dosage is administered at lower levels and increased until the desired effect is achieved.

When lipids are used to deliver the nucleic acid, the amount of lipid compound that is administered can vary and generally depends upon the amount of nucleic acid being administered. For example, the weight ratio of lipid compound to nucleic acid is preferably from about 1:1 to about 30:1, with a weight ratio of about 5:1 to about 10:1 being more preferred.

A suitable dosage unit of nucleic acid molecules may be in the range of 0.001 to 0.25 milligrams per kilogram body weight of the recipient per day, or in the range of 0.01 to 20 micrograms per kilogram body weight per day, or in the range of 0.01 to 10 micrograms per kilogram body weight per day, or in the range of 0.10 to 5 micrograms per kilogram body weight per day, or in the range of 0.1 to 2.5 micrograms per kilogram body weight per day.

Suitable amounts of nucleic acid molecules may be introduced and these amounts can be empirically determined using standard methods. Effective concentrations of individual nucleic acid molecule species in the environment of a cell may be about 1 femtomolar, about 50 femtomolar, 100 femtomolar, 1 picomolar, 1.5 picomolar, 2.5 picomolar, 5 picomolar, 10 picomolar, 25 picomolar, 50 picomolar, 100 picomolar, 500 picomolar, 1 nanomolar, 2.5 nanomolar, 5 nanomolar, 10 nanomolar, 25 nanomolar, 50 nanomolar, 100 nanomolar, 500 nanomolar, 1 micromolar, 2.5 micromolar, 5 micromolar, 10 micromolar, 100 micromolar or more.

Dosage may be from 0.01 µg to 1 g per kg of body weight (e.g., 0.1 µg, 0.25 µg, 0.5 µg, 0.75 µg, 1 µg, 2.5 µg, 5 µg, 10 µg, 25 µg, 50 µg, 100 µg, 250 µg, 500 µg, 1 mg, 2.5 mg, 5 mg, 10 mg, 25 mg, 50 mg, 100 mg, 250 mg, or 500 mg per kg).

Dosage levels of the order of from about 0.1 mg to about 140 mg per kilogram of body weight per day are useful in the treatment of the above-indicated conditions (about 0.5 mg to about 7 g per subject per day). The amount of active ingredient that can be combined with the carrier materials to produce a single dosage form varies depending upon the host treated and the particular mode of administration. Dosage unit forms generally contain between from about 1 mg to about 500 mg of an active ingredient.

It is understood that the specific dose level for any particular subject depends upon a variety of factors including the activity of the specific compound employed, the age, body weight, general health, sex, diet, time of administration, route of administration, and rate of excretion, drug combination and the severity of the particular disease undergoing therapy.

Pharmaceutical compositions that include the nucleic acid molecule disclosed herein may be administered once daily, qid, tid, bid, QD, or at any interval and for any duration that is medically appropriate. However, the therapeutic agent may also be dosed in dosage units containing two, three, four, five, six or more sub-doses administered at appropriate intervals throughout the day. In that case, the nucleic acid molecules contained in each sub-dose may be correspondingly smaller in order to achieve the total daily dosage unit. The dosage unit can also be compounded for a single dose over several days, e.g., using a conventional sustained release formulation which provides sustained and consistent release of the dsRNA over a several day period. Sustained release formulations are well known in the art. The dosage unit may contain a corresponding multiple of the daily dose. The composition can be compounded in such a way that the sum of the multiple units of a nucleic acid together contain a sufficient dose.

Pharmaceutical Compositions, Kits, and Containers

Also provided are compositions, kits, containers and formulations that include a nucleic acid molecule (e.g., an siNA molecule) as provided herein for reducing expression of hsp47 for administering or distributing the nucleic acid molecule to a patient. A kit may include at least one container and at least one label. Suitable containers include, for example, bottles, vials, syringes, and test tubes. The containers can be formed from a variety of materials such as glass, metal or plastic. The container can hold amino acid sequence(s), small molecule(s), nucleic acid sequence(s), cell population(s) and/or antibody(s). In one embodiment, the container holds a polynucleotide for use in examining the mRNA expression profile of a cell, together with reagents used for this purpose. In another embodiment a container includes an antibody, binding fragment thereof or specific binding protein for use in evaluating hsp47 protein expression cells and tissues, or for relevant laboratory, prognostic, diagnostic, prophylactic and therapeutic purposes; indications and/or directions for such uses can be included on or with such container, as can reagents and other compositions or tools used for these purposes. Kits may further include associated indications and/or directions; reagents and other compositions or tools used for such purpose can also be included.

The container can alternatively hold a composition that is effective for treating, diagnosis, prognosing or prophylaxing a condition and can have a sterile access port (for example the container can be an intravenous solution bag or a vial having a stopper pierceable by a hypodermic injection needle). The active agents in the composition can be a nucleic acid molecule capable of specifically binding hsp47 and/or modulating the function of hsp47.

A kit may further include a second container that includes a pharmaceutically-acceptable buffer, such as phosphate-buffered saline, Ringer's solution and/or dextrose solution. It can further include other materials desirable from a commercial and user standpoint, including other buffers, diluents, filters, stirrers, needles, syringes, and/or package inserts with indications and/or instructions for use.

The units dosage ampoules or multidose containers, in which the nucleic acid molecules are packaged prior to use, may include an hermetically sealed container enclosing an amount of polynucleotide or solution containing a polynucleotide suitable for a pharmaceutically effective dose thereof, or multiples of an effective dose. The polynucleotide is packaged as a sterile formulation, and the hermetically sealed container is designed to preserve sterility of the formulation until use.

The container in which the polynucleotide including a sequence encoding a cellular immune response element or fragment thereof may include a package that is labeled, and the label may bear a notice in the form prescribed by a governmental agency, for example the Food and Drug Administration, which notice is reflective of approval by the agency under Federal law, of the manufacture, use, or sale of the polynucleotide material therein for human administration.

Federal law requires that the use of pharmaceutical compositions in the therapy of humans be approved by an agency of the Federal government. In the United States, enforcement is the responsibility of the Food and Drug Administration, which issues appropriate regulations for securing such approval, detailed in 21 U.S.C. §301-392. Regulation for biologic material, including products made from the tissues of animals is provided under 42 U.S.C. §262. Similar approval is required by most foreign countries. Regulations vary from country to country, but individual procedures are well known to those in the art and the compositions and methods provided herein preferably comply accordingly.

The dosage to be administered depends to a large extent on the condition and size of the subject being treated as well as the frequency of treatment and the route of administration. Regimens for continuing therapy, including dose and frequency may be guided by the initial response and clinical judgment. The parenteral route of injection into the interstitial space of tissues is preferred, although other parenteral routes, such as inhalation of an aerosol formulation, may be required in specific administration, as for example to the mucous membranes of the nose, throat, bronchial tissues or lungs.

As such, provided herein is a pharmaceutical product which may include a polynucleotide including a sequence encoding a cellular immune response element or fragment thereof in solution in a pharmaceutically acceptable injectable carrier and suitable for introduction interstitially into a tissue to cause cells of the tissue to express a cellular immune response element or fragment thereof, a container enclosing the solution, and a notice associated with the container in form prescribed by a governmental agency regulating the manufacture, use, or sale of pharmaceuticals, which notice is reflective of approval by the agency of manufacture, use, or sale of the solution of polynucleotide for human administration.

Indications

The nucleic acid molecules disclosed herein can be used to treat diseases, conditions or disorders associated with hsp47, such as liver fibrosis, cirrhosis, pulmonary fibrosis, kidney fibrosis, peritoneal fibrosis, chronic hepatic damage, and fibrillogenesis and any other disease or conditions that are related to or will respond to the levels of hsp47 in a cell or tissue, alone or in combination with other therapies. As such, compositions, kits and methods disclosed herein may include packaging a nucleic acid molecule disclosed herein that includes a label or package insert. The label may include indications for use of the nucleic acid molecules such as use for treatment or prevention of liver fibrosis, peritoneal fibrosis, kidney fibrosis and pulmonary fibrosis, and any other disease or conditions that are related to or will respond to the levels of hsp47 in a cell or tissue, alone or in combination with other therapies. A label may include an indication for use in reducing expression of hsp47. A "package insert" is used to refer to instructions customarily included in commercial packages of therapeutic products, that contain information about the indications, usage, dosage, administration, contraindications, other therapeutic products to be combined with the packaged product, and/or warnings concerning the use of such therapeutic products, etc.

Those skilled in the art will recognize that other anti-fibrosis treatments, drugs and therapies known in the art can be readily combined with the nucleic acid molecules herein (e.g. siNA molecules) and are hence contemplated herein.

The methods and compositions provided herein will now be described in greater detail by reference to the following non-limiting examples.

EXAMPLE 1

Selecting hsp47 Nucleic Acid Molecule Sequences

Nucleic acid molecules (e.g., siNA≤25 nucleotides) against Hsp47 were designed using several computer programs including siRNA at Whitehead (Whitehead Institute for Biomedical Research), IDT siRNA Design (Integrated DNA Technologies), BLOCK-iT RNAi Designer (Invitrogen), siDESIGN Center (Dharmacon), and BIOPREDsi (Friedrich Miescher Institute for Biomedical Research, part of the Novartis Research Foundation, available at http://www.biopredsi.orgistart.html). The sequences of top scored siRNAs from these programs were compared and selected (see Table 1) based on the algorithms as well as the sequence homology between human and rat. Candidate sequences were validated by in vitro knocking down assays.

Several parameters were considered for selecting a nucleic acid molecule (e.g., a 21-mer siRNA) sequence. Exemplary parameters include:
1) thermodynamic stability (RISC favors the strand with less stable 5' end)
2) 30-52% GC content
3) positional nucleotide preference:
(C/G)NNNNNNNN(A/U)10NNNNNNNN(A/U), where N is any nucleotide
4) devoid of putative immunostimulatory motifs
5) 2-nucleotide 3' overhang
6) position of siRNA within the transcript (preferably within cDNA region)
7) sequence specificity (checked by using BLAST)
8) variations in single nucleotide by checking SNP database siRNA sequences having ≤25 nucleotides were designed based on the foregoing methods. Corresponding Dicer substrate siRNA (e.g., ≥26 nucleotides) were designed based on the smaller sequences and extend the target site of the siNA≤2.5 nucleotide by adding 4 bases to the 3'-end of the sense strand and 6 bases to the 5'-end of the antisense strand. The Dicer substrates that were made generally have a 25 base sense strand a 27 base antisense strand with an asymmetric blunt ended and 3'-overhang molecule. The sequences of the sense and the anti-sense strand without base modification (base sequence) and with modifications (experimental sequence) are provided in Table 1.

EXAMPLE 2

In order to screen for the potent of various siNA molecules against both the human and rat hsp47 genes, various reporter cell lines were established by lenti-viral induction of human HSP47 cDNA-green fluorescent protein (GFP) or rat GP46 cDNA-GFP construct into 293, HT1080, human HSC line hTERT, or NRK cell lines. These cell lines were further evaluated by siRNA against GFP. The remaining fluorescence signal was measured and normalized to scrambled siRNA (Ambion) and subsequently normalized to cell viability. The results showed that siRNA against GFP knocks down the fluorescence to different extent in different cell lines (FIG. 1). 293_HSP47-GFP and 293_GP46-GFP cell lines were selected for siHsp47 screening due to their ease of transfection and sensitivity to fluorescence knockdown.

siRNA Transfection:

Cells were transfected with 1.5 pmol per well of siNA against GFP in 96-well tissue culture plates using Lipofectamine RNAiMAX (Invitrogen) in a reverse transfection manner. Cells were seeded at 6,000 cells per well and mixed with the siNA complexes. Fluorescence readings were taken after 72 hours incubation on a Synergy 2 Multi-Mode Microplate Reader (BioTek).

Cell Viability Assay:

Cells treated with or without siNA were measured for viability after 72 hours incubation using CellTiter-Glo Luminescent Cell Viability Assay Kit according to the manual (Promega). The readings were normalized to samples treated with scrambled siNA molecules.

EXAMPLE 3

Figure 2:
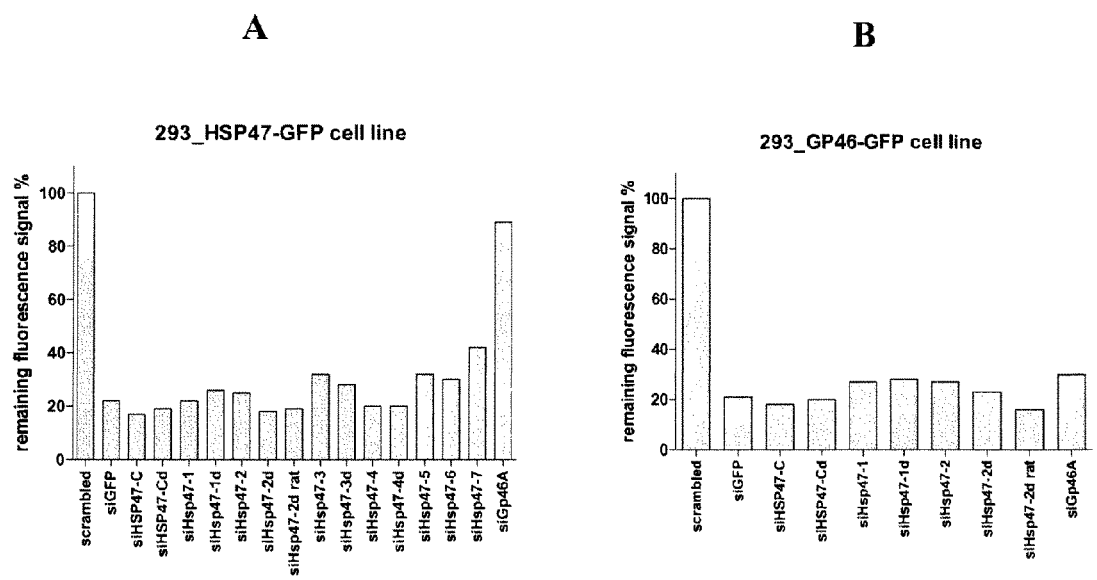
FIG. 2 is a series of bar graphs showing the cytotoxicity and knockdown efficiency of various siHsp47s in 293_HSP47-GFP and 293_GP46-GFP cell lines. The result showed that siHsp47-C, siHsp47-2 and siHsp47-2d efficiently knockdown both human HSP47 and rat GP46 (the human hsp47 homolog) without substantial cytotoxicity. siGp46A against GP46 does not knock down human HSP47. Additionally, the newly designed siHsp47s outperformed siGp46A in knocking down rat GP46.

Evaluation of Inhibitory Efficiency of siHsp47 on hsp47 Expression in Reporter Cell Lines siNAs against hsp47 were evaluated for their inhibitory efficiency in 293 HSP47-GFP and 293_GP46-GFP cell lines by evaluating the change in fluorescent signal from the reporter GFP. The experiments were carried out as described in Example 2. The fluorescent signals were normalized to fluorescent signals from cells treated with scrambled siRNA (Ambion) which served as a control. The results indicate that the tested hsp47 siNA molecules were effective in inhibiting hsp47 mRNA in both cell lines. However, siNA against GP46 mRNA (as published in the 2008 Sato et al paper) was effective only in the 293 GP46-GFP cell line. The results are shown in FIG. 2 A-B.

The 293_HSP47-GFP and 293_GP46-GFP cell lines treated with siRNA against hsp47 and gp46 were evaluated for viability using the methods described in Example 2. The cell viability was normalized to cells treated with scrambled siRNA (Ambion). The results indicate that the cell viability was not affected significantly by the treatment with siNA molecules. However, the cell viability of 293_HSP47-GFP cell lines treated with different hsp47 siNA molecules varied depending on the siNA molecules used, while the viability of 293_GP46-GFP cell lines were similar. Viability for 293 HSP47-GFP cells were lower for siHsp47-6 and Hsp47-7 treated cells than the rest. The results are shown in FIG. 2C-D.

EXAMPLE 4

Evaluation of siHsp47 Inhibitory Effect on hsp47 mRNA by TaqMan® qPCR

In Example 3, the knock down efficiency of siHsp47s in reporter cell lines was evaluated by change in fluorescent signal. To validate the results at the mRNA level, siRNAs targeting endogenous hsp47 were transfected into cells of the human HSC cell line hTERT using Lipofectamine RNAiMAX (Invitrogen) in a reverse transfection manner as described in Example 2.

Figure 3:
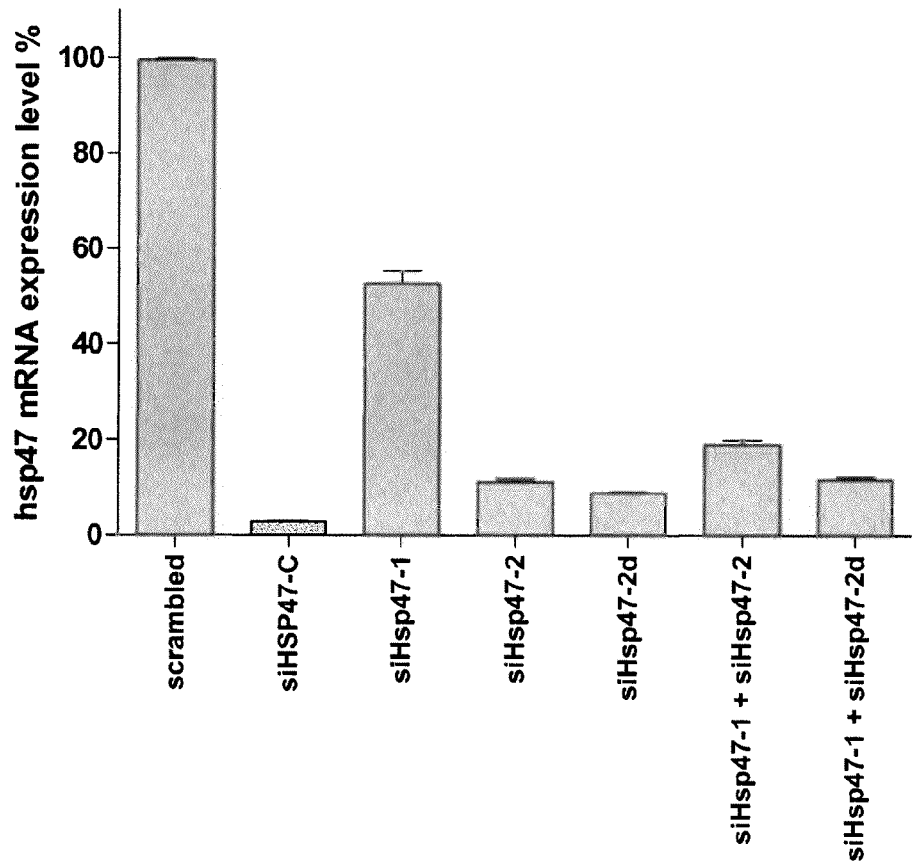
FIG. 3 is a bar graph showing the knock down effect of various siHsp47s on hsp47 mRNA, measured by TaqMan® qPCR using the human HSC cell line hTERT. The Y axis represents the remaining mRNA level of hsp47. HSP47-C was most effective among all the hsp47 siNAs tested.

The hsp47 mRNA level was evaluated for knock down efficiency of the various tested siHsp47 siNA molecules. Briefly, mRNA were isolated from hTERT cells after 72 hours after transfection using an RNeasy mini kit (Qiagen). The level of hsp47 mRNA was determined by reverse transcription coupled with quantitative PCR using TaqMan® probes. Briefly, cDNA synthesis was carried out using High-Capacity cDNA Reverse Transcription Kit (ABI) according to the manufacturer's instruction, and subjected to TaqMan Gene Expression Assay (ABI, hsp47 assay ID Hs01060395_g1). The level of hsp47 mRNA was normalized to the level of GAPDH mRNA according to the manufacturer's instruction (ABI). The results indicate that siHsp47-C was the most effective among all the hsp47 siRNAs, siHsp47-2 and siHsp47-2d were the next most effective. The combinations of siHsp47-1 with siHsp47-2 or siHsp47-1 with siHsp47-2d were more effective than siHsp47-1 alone. The results are shown in FIG. 3.

EXAMPLE 5

Validation of siHsp47 Knock Down Effect at the Protein Level

The inhibitory effect of different Hsp47 siNA molecules (siHsp47) on hsp47 mRNA expression were validated at the protein level by measuring the HSP47 in hTERT cells transfected with different siHsp47. Transfection of hTERT cells with different siHsp47 were performed as described in Example 2. Transfected hTERT cells were lysed and the cell lysate were clarified by centrifugation. Proteins in the clarified cell lysate were resolved by SDS polyacrylamide gel electrophoresis. The level of HSP47 protein in the cell lysate were determined using an anti-HSP47 antibody (Assay Designs) as the primary antibody, Goat anti-mouse IgG conjugated with HRP (Millipore) as the secondary antibody, and subsequently detected by Supersignal West Pico Chemiluminescence kit (Pierce). Anti-actin antibody (Abeam) was used as a protein loading control. The result showed significant decrease in the level of Hsp47 protein in cells treated with siHsp47-C, siHsp47-2d, alone or combination of siHsp47-1 with siHsp47-2d.

EXAMPLE 6

Downregulation of Collagen I expression by hsp47 siRNA

Figure 4:
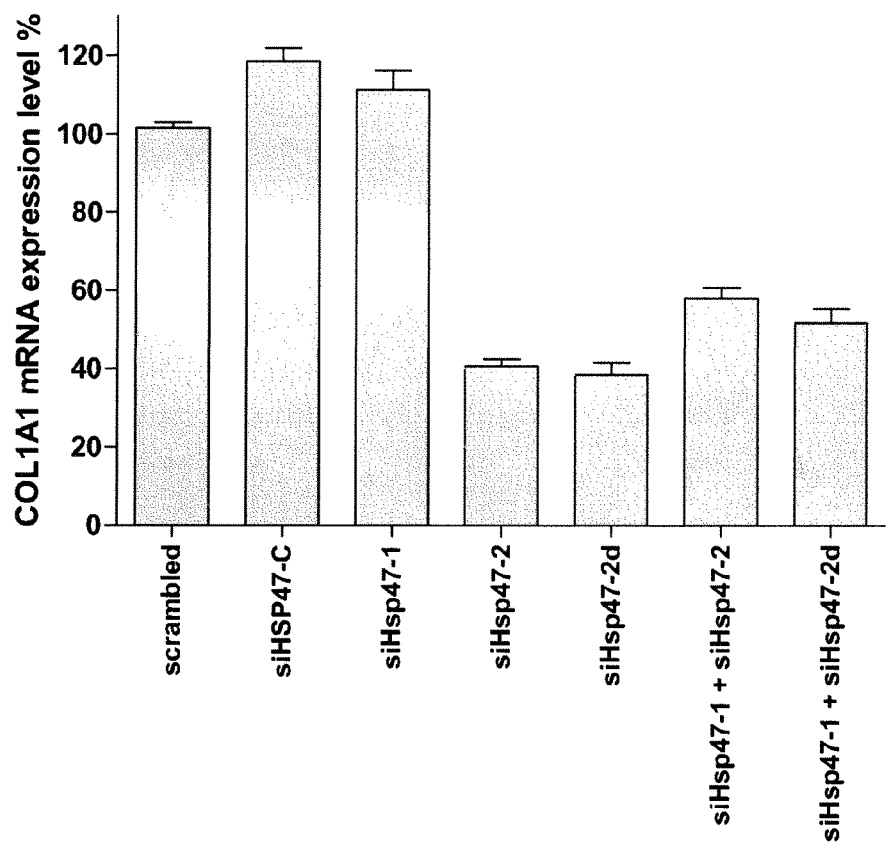
FIG. 4 is a bar graph showing the effect of different hsp47 siNAs on collagen I expression in hTERT cells. The level of collagen I mRNA levels were measured by real-time quantitative PCR using TaqMan® probe. The Y axis represents the remaining mRNA expression level of collagen I. The result showed that collagen I mRNA level is significantly reduced in the cells treated with some of the candidates (siHsp47-2, siHsp47-2d, and their combination with siHsp47-1).

To determine the effect of siHsp47 on collagen I expression level, collagen I mRNA level in hTERT cells treated with different siRNA against hsp47 was measured. Briefly, hTERT cells were transfected with different siHsp47 as described in Example 2. The cells were lysed after 72 hours and mRNA were isolated using RNeasy mini kit according to the manual (Qiagen). The level of collagen 1 mRNA was determined by reverse transcription coupled with quantitative PCR using TaqMan® probes. Briefly, cDNA synthesis was carried out using High-Capacity cDNA Reverse Transcription Kit (ABI) according to the manual, and subjected to TaqMan Gene Expression Assay (ABI, COL1A1 assay ID Hs01076780_g1). The level of collagen I mRNA was normalized to the level of GAPDH mRNA according to the manufacturer's instruction (ABI). The signals were normalized to the signal obtained from cells transfected with scrambled siNA. The result indicated that collagen I mRNA level is significantly reduced in the cells treated with some of the candidates siHsp47-2, siHsp47-2d, and their combination with siHsp47-1 and shown in FIG. 4.

EXAMPLE 7

Immunofluorescence Staining of hsp47 siRNA Treated hTERT Cells

To visualize the expression of two fibrosis markers, collagen 1 and alpha-smooth muscle actin (SMA), in hTERT cells transfected with or without siHsp47, the cells were stained with rabbit anti-collagen I antibody (Abeam) and mouse anti-alpha-SMA antibody (Sigma). Alexa Fluor 594 goat anti-mouse IgG and Alexa Fluor 488 goat anti-rabbit IgG (Invitrogen (Molecular Probes)) were used as secondary antibodies to visualize collagen I (green) and alpha-SMA (red). Hoescht was used to visualize nucleus (blue). The results indicate correlation between siRNA knocking down of some of the target genes and collagen/SMA expression.

EXAMPLE 8

In Vivo Testing of siHSP47 in Animal Models of Liver Fibrosis siRNA for Rat Liver Cirrhosis Treatment
The siRNA duplex sequence for HSP47 (siHSP47C) is as listed below.

```
Sense     (5'->3')      ggacaggccucuacaacuaTT
Antisense (5'->3')      uaguuguagaggccuguccTT
```

10 mg/ml siRNA stock solution was prepared by dissolving in nuclease free water (Ambion). For treatment of cirrhotic rats, siRNA was formulated with vitamin A-coupled liposome as described by Sato et al (Sato Y. et al. Nature Biotechnology 2008. Vol. 26, p 431) in order to target activated hepatic stellate cells that produce collagen. The vitamin A (VA)-liposome-siRNA formulation consists of 0.33 µmol/ml of VA, 0.33 µmol/ml of liposome (Coatsome EL-01-D, NOF Corporation) and 0.5 µg/µl of siRNA in 5% glucose solution.

The liver cirrhosis animal model was reported by Sato et al (Sato Y. et al. Nature Biotechnology 2008. Vol. 26, p 431). 4 week-old male SD rats were induced with liver cirrhosis with 0.5% dimethylnitrosoamine (DMN) (Wako Chemicals, Japan) in phosphate-buffered saline (PBS). A dose of 2 ml/kg per body weight was administered intraperitoneally for 3 consecutive days per week on days 0, 2, 4, 7, 9, 11, 14, 16, 18, 21, 23, 25, 28, 30, 32, 34, 36, 38 and 40 siRNA treatment: siRNA treatment was carried out from day 32 and for 5 intravenous injections. In detail, rats were treated with siRNA on day-32, 34, 36, 38 and 40. Then rats were sacrificed on day-42 or 43. 3 different siRNA doses (1.5 mg siRNA per kg body weight, 2.25 mg siRNA per kg body weight, 3.0 mg siRNA per kg body weight) were tested. Detail of tested groups and number of animals in each group are as follows:

1) Cirrhosis was induced by DMN injection, then 5% glucose was injected instead of siRNA) (n=10)
2) VA-Lip-siHSP47C1.5 mg/kg (n=10)
3) VA-Lip-siHSP47C 2.25 mg/kg (n=10)
4) VA-Lip-siHSP47C 3.0 mg/Kg (n=10)
5) Sham (PBS was injected instead of DMN. 5% Glucose was injected instead of siRNA) (n=6)
6) No treatment control (Intact) (n=6)
VA-Lip Refers to Vitamin A—Liposome Complex.

Evaluation of therapeutic efficacy: On day 43, 2 out of 10 animals in the "diseased rat" group and 1 out of 10 animals in "VA-Lip-siHSP47C siRNA 1.5 mg/kg" died due to development of liver cirrhosis. The remainder of the animals survived. After rats were sacrificed, liver tissues were fixed in 10% formalin. Then, the left lobule of each liver was embedded in paraffin for histology. Tissue slides were stained with Sirius red, and hematoxylin and eosin (HE). Sirius red staining was employed to visualize collagen-deposits and to determine the level of cirrhosis. HE staining was for nuclei and cytoplasm as counter-staining. Each slide was observed under microscope (BZ-8000, Keyence Corp. Japan) and percentage of Sirius red-stained area per slide was determined by image analysis software attached to the microscope. At least 4 slides per each liver were prepared for image analysis, and whole area of each slide (slice of liver) was captured by camera and analyzed. Statistical analysis was carried out by Student's t-test.

Figure 5:
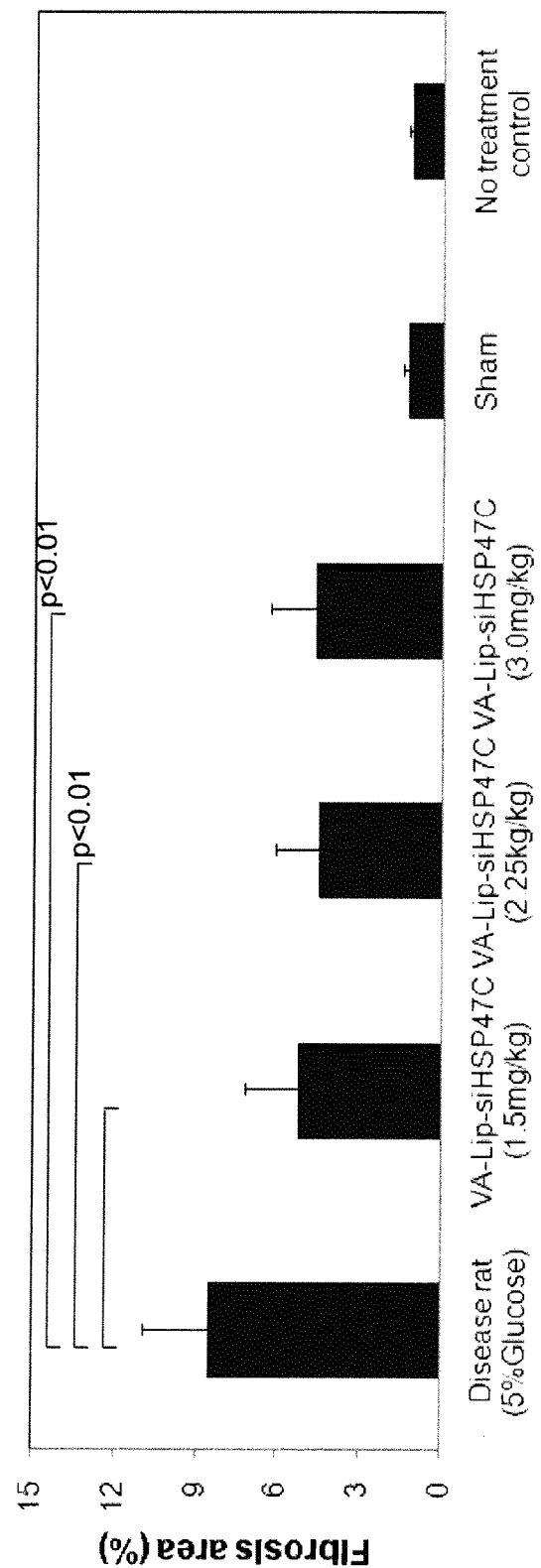
FIG. 5 shows the decrease in fibrotic areas of the liver in animals treated with siHSP47.
Figure 9A:
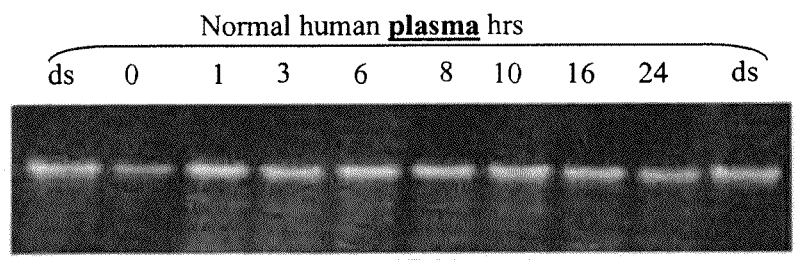
FIGS. 9A-9I show plasma stability of Compound_1, Compound_2, Compound 3, Compound_4, Compound_5, Compound_6, Compound_7, Compound_8 and Compound_9, respectively, as detected by ethidium bromide staining.
Figure 9B:
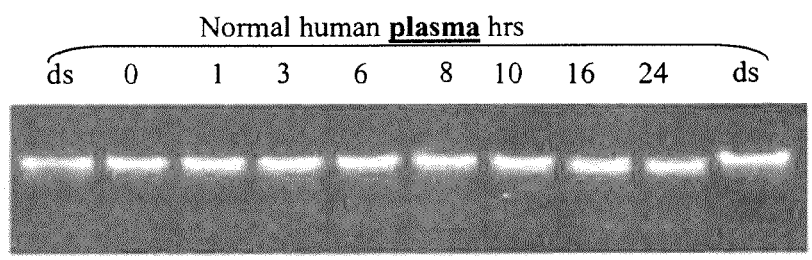
Figure 9C:
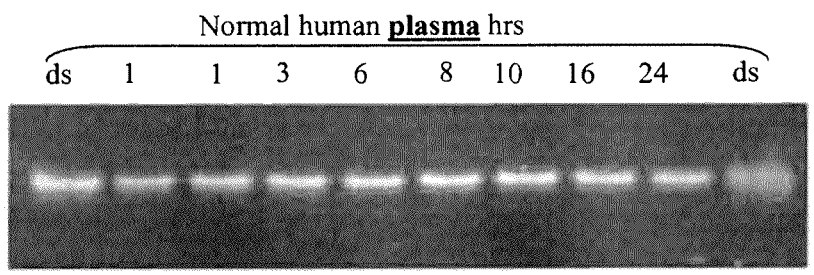
Figure 9D:
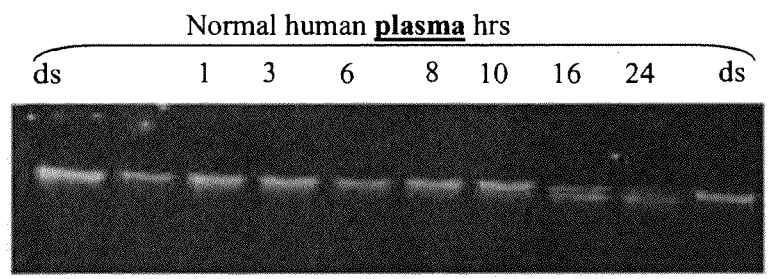
Figure 9E:
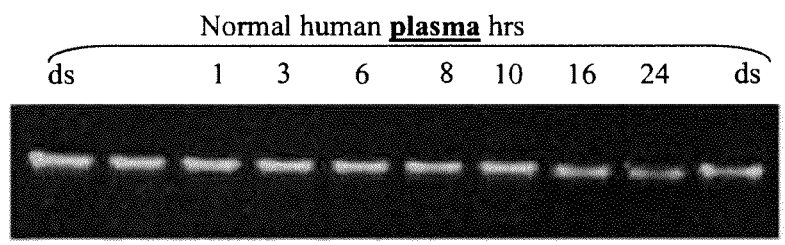
Figure 9F:
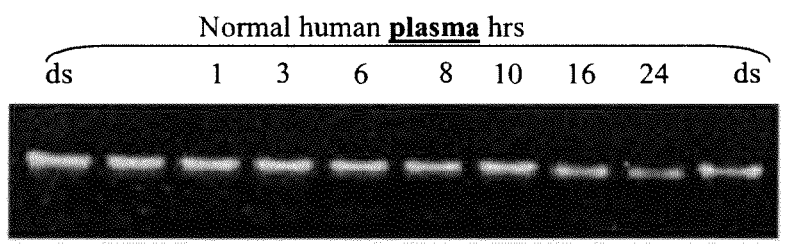
Figure 9G:
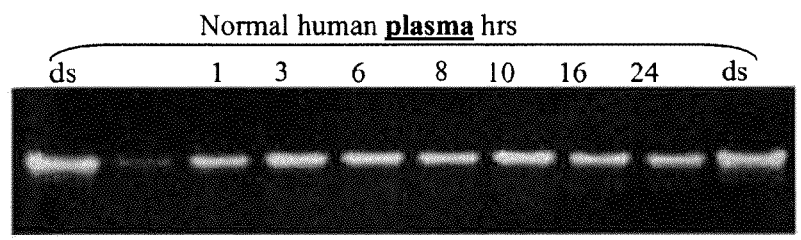
Figure 9H:
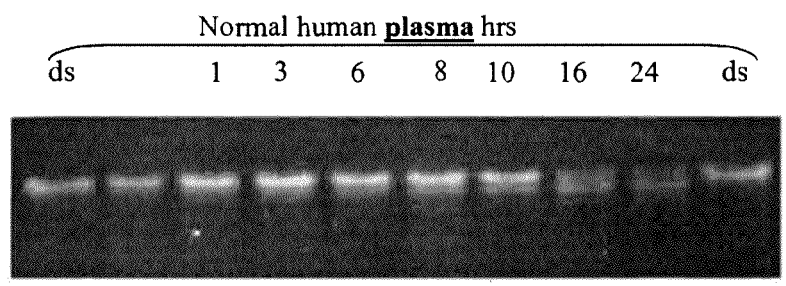
Figure 9I:
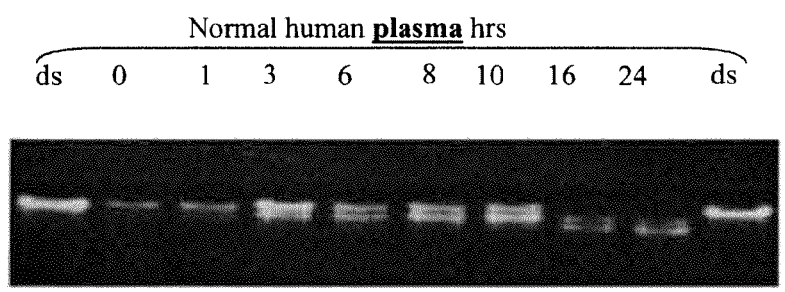
Figure 10A:
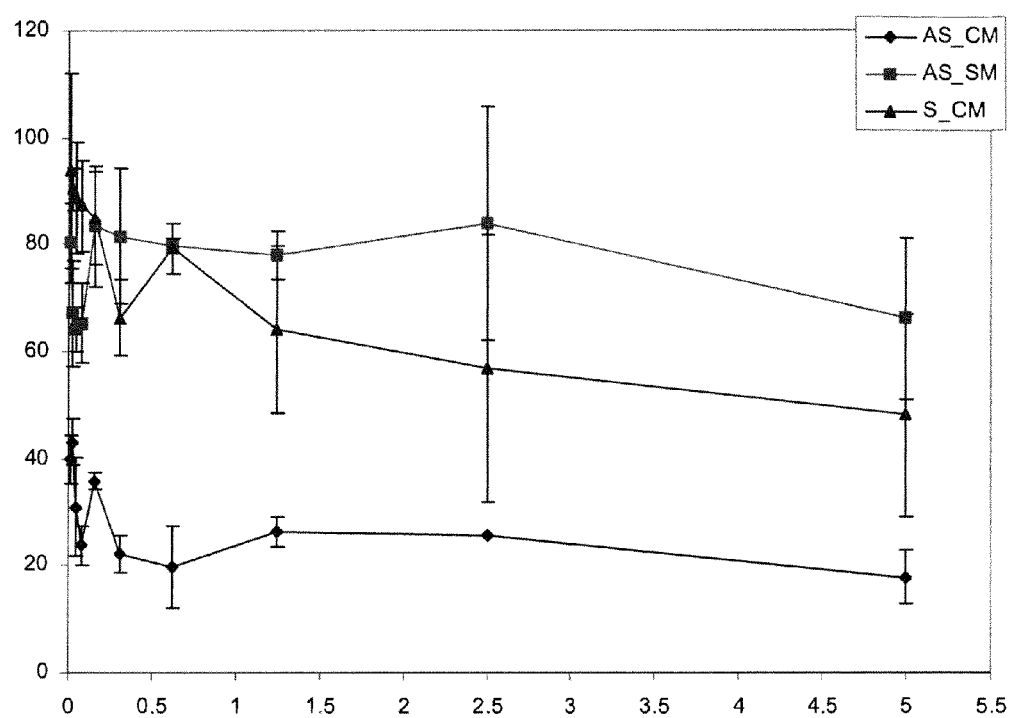
FIGS. 10A-10I show ontarget/off-target activity of Compound_1, Compound_2, Compound_3, Compound_4, Compound_5, Compound_6, Compound_7, Compound_8 and Compound_9, respectively. AS_CM shows activity of antisense strand of compound to a plasmid comprising a full match insert; AS_SM shows activity of antisense strand of compound to a plasmid comprising seed sequence insert; S_CM shows activity of sense strand of compound to a plasmid comprising a full match insert. All assays were performed in human cells, except for data shown in FIG. 10F which was performed in rat REF52 cells.
Figure 10B:
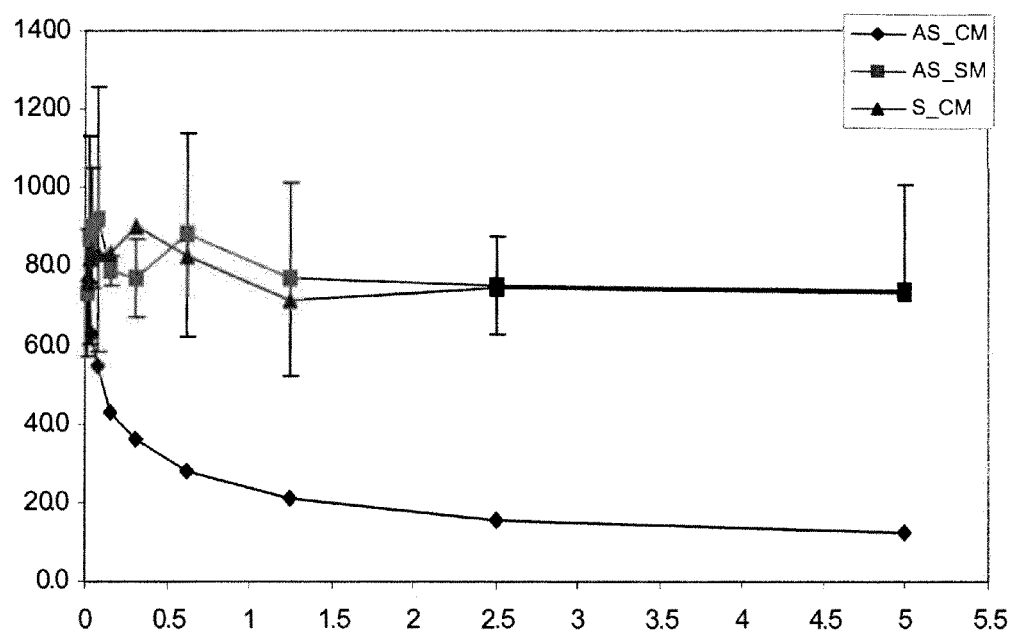
Figure 10C:
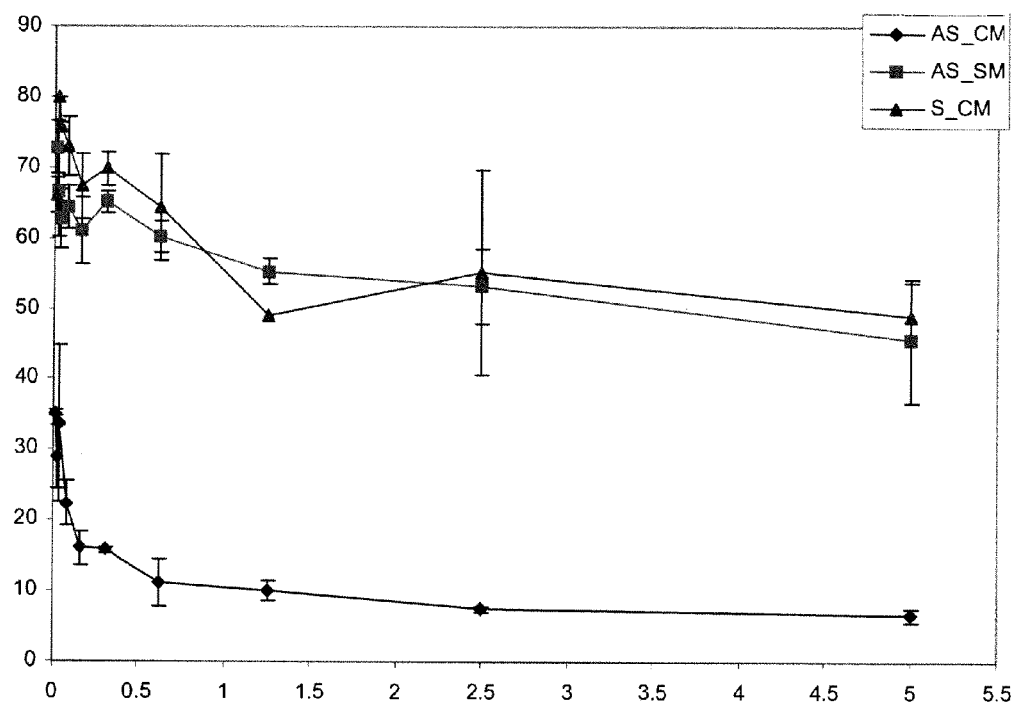
Figure 10D:
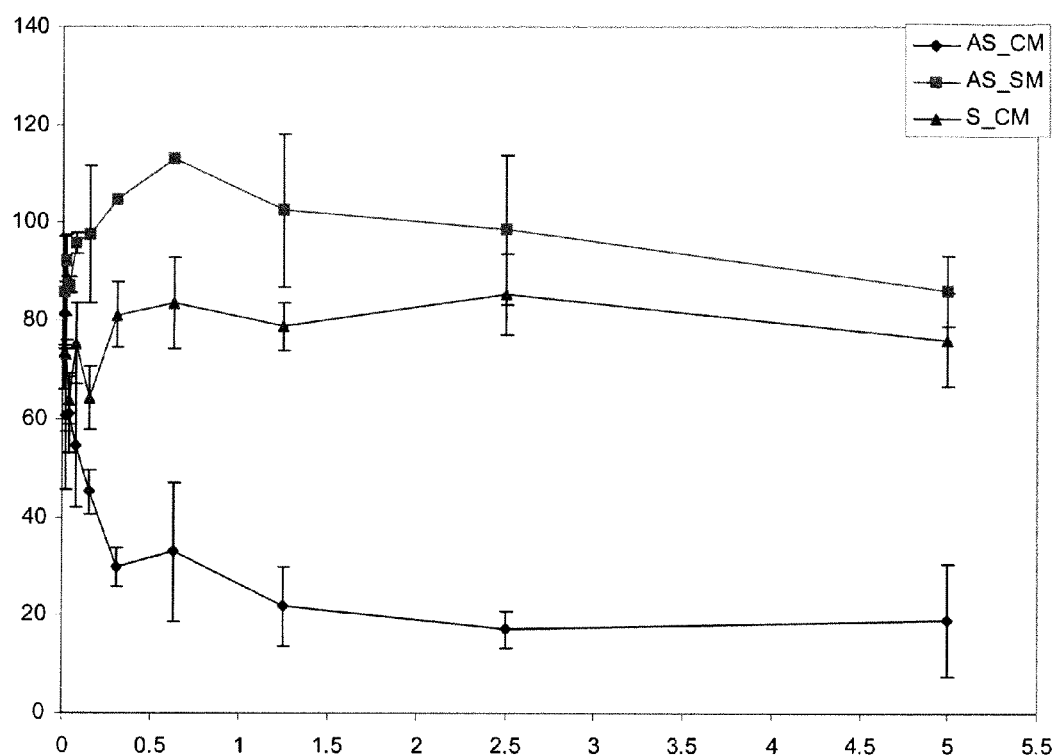
Figure 10E:
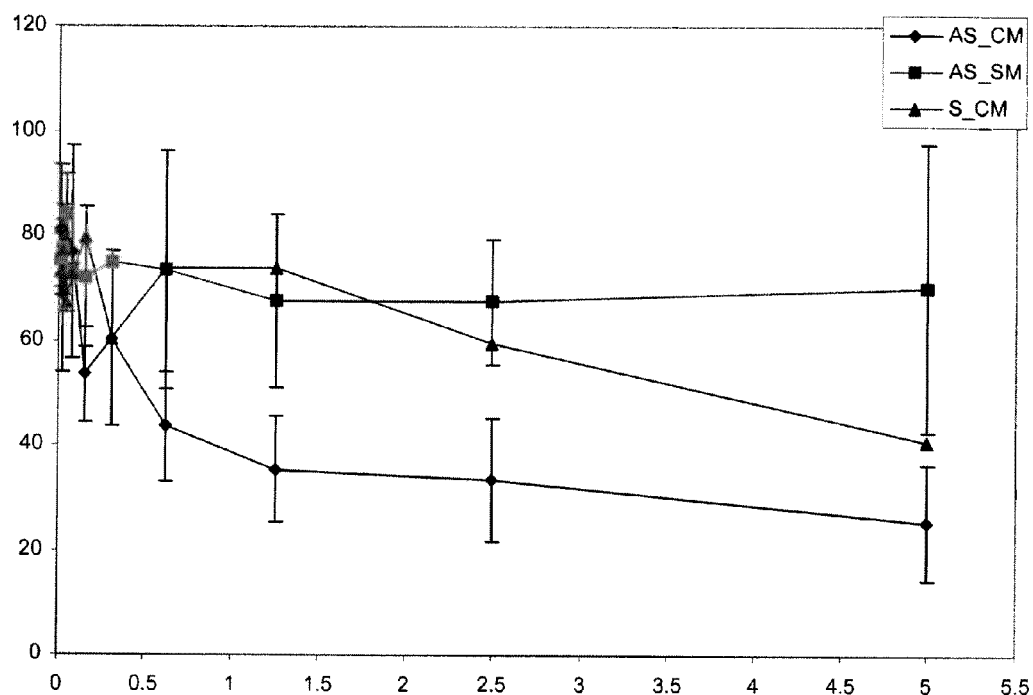
Figure 10F:
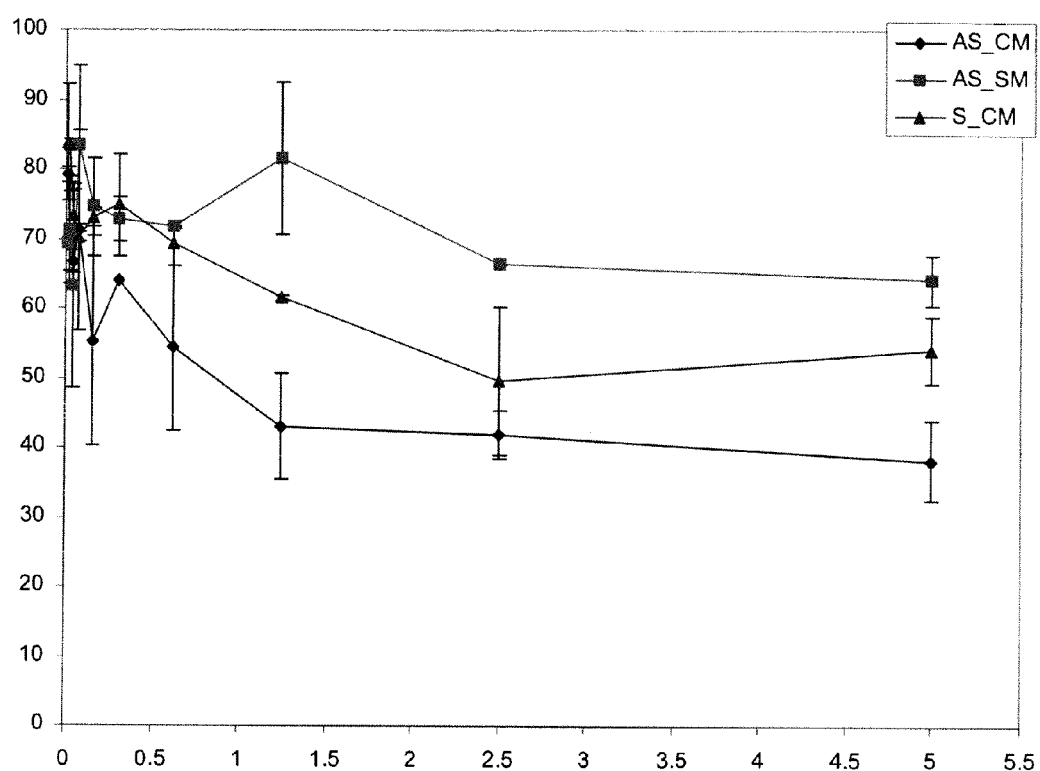
Figure 10G:
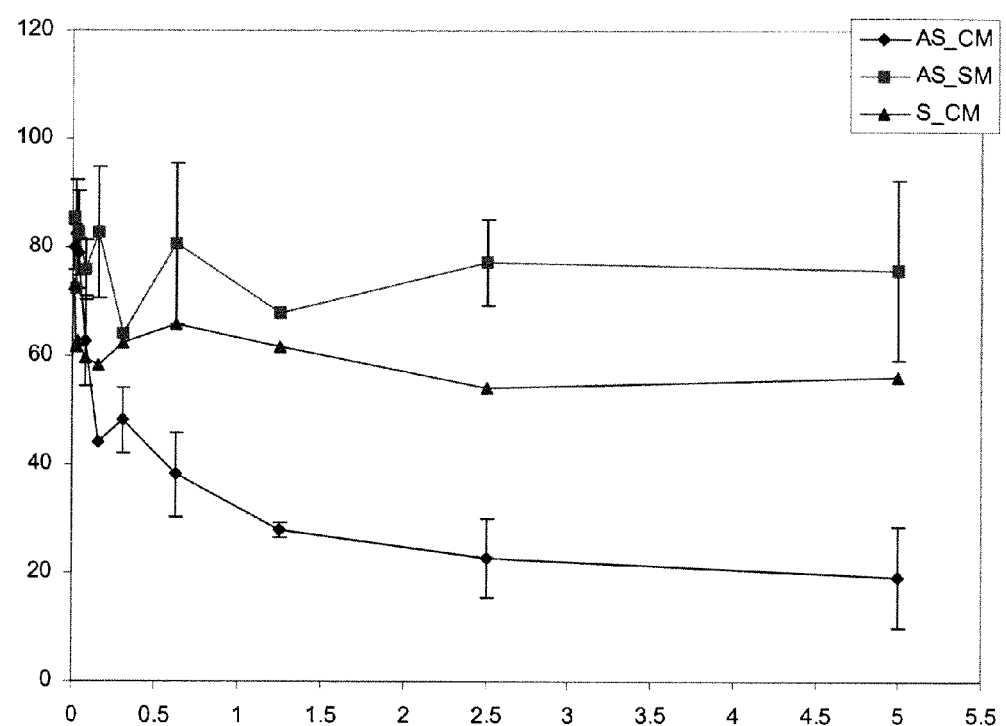
Figure 10H:
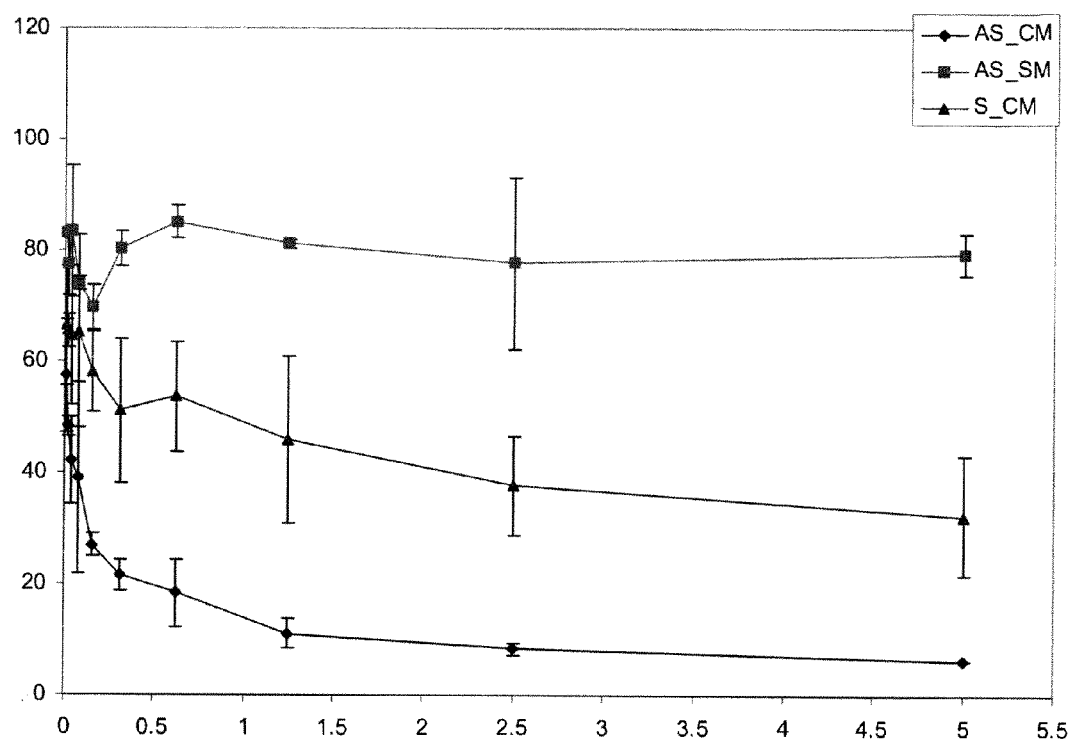
Figure 10I:
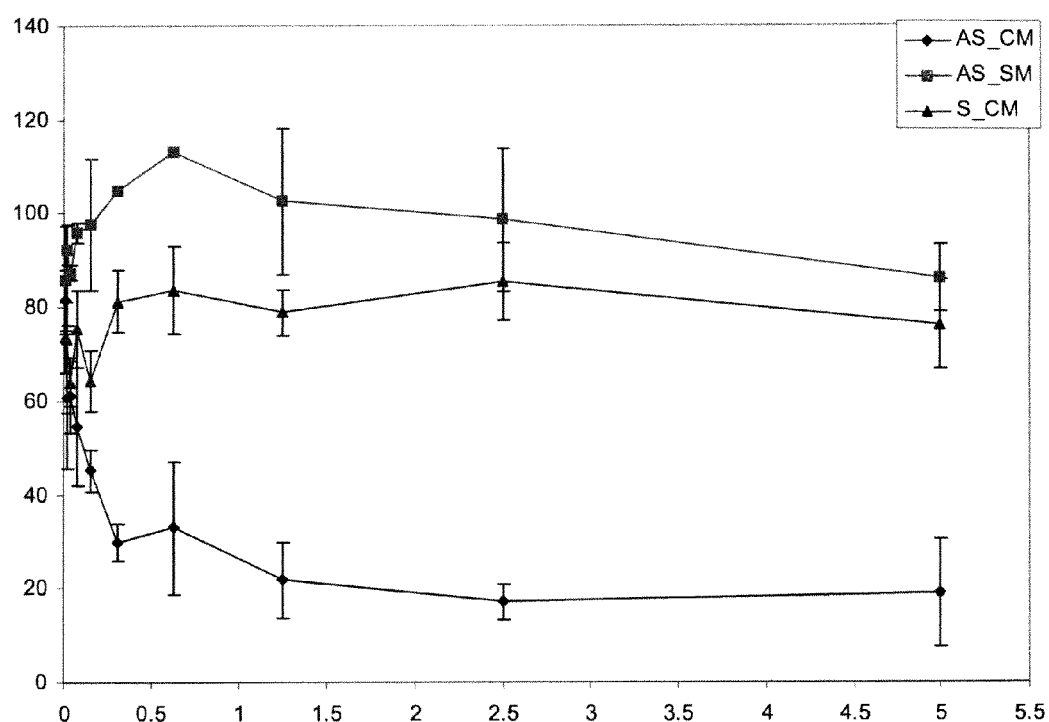

Results: FIG. 5 shows the fibrotic areas. The area of fibrosis in "diseased rats" was higher than in the "sham" or "no treatment control" groups. Therefore, DMN treatment induced collagen deposition in the liver, which was a typical observation of liver fibrosis. However, the area of fibrosis was significantly reduced by the treatment of siRNA targeting HSP47 gene, compared with "disease rat" group (FIG. 5). This result indicates that siRNA as disclosed herein has a therapeutic efficacy in actual disease.

Additional siRNA compounds are tested in the liver fibrosis animal model, and were shown to reduce the fibrotic area in the liver.

EXAMPLE 9

Generation of Sequences for Active Double Stranded RNA Compounds to HSP47/SERPINH1 and Production of the siRNAs Shown in Tables A-18, A-19, and B-E Using proprietary algorithms and the known sequence of the target genes, the sequences of many potential siRNAs were generated. The sequences that have been generated using this method are complementary to the corresponding mRNA sequence.

Duplexes are generated by annealing complementary single stranded oligonucleotides. In a laminar flow hood, a ~500 μM Stock Solution of single stranded oligonucleotide is prepared by diluting in WFI (water for injection, Norbrook). Actual ssRNA concentrations are determined by diluting each 500 μM ssRNA 1:200 using WFI, and measuring the OD using Nano prop. The procedure is repeated 3 times and the average concentration is calculated. The Stock Solution was then diluted to a final concentration of 250 μM. Complementary single strands were annealed by heating to 85° C. and allowing to cool to room temperature over at least 45 minutes. Duplexes were tested for complete annealing by testing 5 μl on a 20% polyacrylamide gel and staining. Samples were stored at −80° C.

Tables A-18, A-19 and B-E provide siRNAs for HSP47/SERPINH1. For each gene there is a separate list of 19-mer siRNA sequences, which are prioritized based on their score in the proprietary algorithm as the best sequences for targeting the human gene expression.

The following abbreviations are used in the Tables A-18, A-19 and B-E herein: "other spec or Sp." refers to cross species identity with other animals: D-dog, Rt-rat, Rb-Rabbit, Rh-rhesus monkey, P-Pig, M-Mouse; ORF: open reading frame. 19-mers, and 18+1-mers refer to oligomers of 19 and 18+1 (U in position 1 of Antisense, A in position 19 of sense strand) ribonucleic acids in length, respectively.

In Vitro Testing of the siRNA Compounds for the Target Genes

Low-Throughput-Screen (LTS) for siRNA Oligos Directed to Human and Rat SERPINH1 Gene.

Cell Lines: Human prostate adenocarcinoma PC3 cells (ATCC, Cat# CRL-1435) were grown in RPMI medium supplemented with 10% FBS and 2 mM L-Glutamine and human epithelial cervical cancer HeLa cells (ATCC, Cat#CCL-2) were maintained in Dulbecco's modified Eagle's medium (DMEM) supplemented with 10% FBS, 2 mM L-glutamine. Cells were maintained at 37° C. in 5% $CO_2$.

About $2\times10^5$ human PC-3 cells endogenously expressing SERPINH1 gene, were inoculated in 1.5 mL growth medium in order to reach 30-50% confluence after 24 hours. Cells were transfected with Lipofectamine™2000 reagent to a final concentration of 0.01-5 nM per transfected cells. Cells were incubated at 37±1° C., 5% $CO_2$ for 48 hours. siRNA transfected cells were harvested and RNA was isolated using EZ-RNA kit [Biological Industries (#20-410-100)].

Reverse transcription was performed as follows: Synthesis of cDNA was performed and human SERPINH1 mRNA levels were determined by Real Time qPCR and normalized to those of the Cyclophilin A (CYNA, PPIA) mRNA for each sample. siRNA activity was determined based on the ratio of the SERPINH1 mRNA quantity in siRNA-treated samples versus non-transfected control samples.

The most active sequences were selected from further assays. From Table A-18 siRNA compounds SERPINH1_2, SERPINH1_6, SERPINH1_13, SERPINH1_45 SERPINH1_45a, SERPINH1_51, SERPINH1_51a, SERPINH1_52 and SERPINH1_86 were selected as preferred compounds. From Table A-19 siRNA compounds SERPINH1_4, SERPINH1_12, SERPINH1_18, SERPINH1_30, SERPINH1_58 and SERPINH1_88 were selected as preferred compounds.

Other preferred compounds include SERPINH1_50, SERPINH1_67, SERPINH1_73, SERPINH1_74.

IC50 Values for the LTS Selected SERPINH1 siRNA Oligos

About $2\times10^5$ human PC-3 or $0.9\times10^5$ rat REF52 cells endogenously expressing SERPINH1 gene, were inoculated in 1.5 mL growth medium in order to reach 30-50% confluence. Cells were transfected with SERPINH1 double stranded RNA compounds (I.e. SERPINH1_2, 4, 6, 12, 13, 18, 45, 51, 58, 88) with Lipofectamine™2000 reagent to reach final transfection concentrations ranging between 0.0029-100 nM. As negative control cells are treated with Lipofectamine™2000 reagent or with Synthetic randomized-sequence, non-targeting siRNA at final concentrations of 20-100 nM. Cy3-labeled siRNA transfected cells were used as positive control for transfection efficiency.

Cells were incubated at 37±1° C., 5% CO2 for 48 hours. siRNA transfected cells were harvested and RNA was isolated using EZ-RNA kit [Biological Industries (#20-410-100) Reverse transcription: Synthesis of cDNA is performed and human SERPINH1 mRNA levels were determined by Real Time qPCR and normalized to those of the Cyclophilin A (CYNA, PPIA) mRNA for each sample.

The $IC_{50}$ value of the tested RNAi activity was determined by constructing a dose-response curve using the activity results obtained with the various final siRNA concentrations. The dose response curve was constructed by plotting the relative amount of residual SERPINH1 mRNA versus the logarithm of transfected siRNA concentration. The curve is calculated by fitting the best sigmoid curve to the measured data. The method for the sigmoid fit is also known as a 3-point curve fit.

$$Y = Bot + \frac{100 - Bot}{1 + 10^{(LogIC50 - X) \times HillSlope}}$$

where Y is the residual SERPINH1 mRNA response, X is the logarithm of transfected siRNA concentration, Bot is the Y value at the bottom plateau, LogIC50 is the X value when Y is halfway between bottom and top plateaus and HillSlope is the steepness of the curve.

The percent of inhibition of gene expression using specific siRNAs was determined using qPCR analysis of target gene in cells expressing the endogenous gene. Other siRNA compounds according to Tables A-18, A-19 and B-E are tested in vitro where it is shown that these siRNA compounds inhibit gene expression. Activity is shown as percent residual mRNA; accordingly, a lower value reflects better activity.

In order to test the stability of the siRNA compounds in serum, specific siRNA molecules were incubated in four different batches of human serum (100% concentration) at 37° C. for up to 24 hours. Samples are collected at 0.5, 1, 3, 6, 8, 10, 16 and 24 hours. The migration patterns as an indication of were determined at each collection time by polyacrylamide gel electrophoresis (PAGE).

Table 3 shows 1050 (or activity where 1050 not calculated) in human cell line for unmodified double stranded nucleic acid compounds (sense and antisense strand unmodified, dTdT 3' terminal overhangs) selected from Tables A-18 and A-19.

TABLE 3

| siRNA | AntiSense 1$^{st}$ position | structure | IC50 | 0.1 nM | 0.5 nM | 5 nM |
|---|---|---|---|---|---|---|
| SERPINH1_6_S709 | U | A2 | 0.019 | | | |
| SERPINH1_12_S709 | A | A1 | 0.065 | | | |
| SERPINH1_23_S709 | U | A2 | 0.377 | | | |
| SERPINH1_54_S709 | A | A1 | 0.522 | | | |
| SERPINH1_37_S709 | U | A2 | 0.11 | | | |
| SERPINH1_73_S709 | A | A1 | 0.189 | | | |
| SERPINH1_24_S709 | U | A2 | 0.271 | | | |
| SERPINH1_55_S709 | A | A1 | 0.268 | | | |
| SERPINH1_60_S709 | U | A2 | 0.163 | | | |
| SERPINH1_88_S709 | A | A1 | 0.135 | | | |
| SERPINH1_11_S709 | U | A2 | 0.079 | | | |
| SERPINH1_30_S709 | A | A1 | 0.093 | | | |
| SERPINH1_25_S709 | U | A2 | 0.229 | | | |
| SERPINH1_56_S709 | A | A1 | 0.469 | | | |
| SERPINH1_5_S709 | U | A2 | 0.178 | | | |
| SERPINH1_81_S709 | G | A1 | 1.404 | | | |
| SERPINH1_52_S709 | U | A2 | 0.06 | | | |
| SERPINH1_58_S709 | A | A1 | 0.304 | | | |
| SERPINH1_2_S709 | U | A2 | 0.008 | | | |
| SERPINH1_4_S709 | A | A1 | 0.006 | | | |
| SERPINH1_43_S709 | U | A2 | 1.403 | | | |
| SERPINH1_67_S709 | A | A1 | 2.39 | | | |
| SERPINH1_16_S709 | U | A2 | | 134 | 95 | 16 |
| SERPINH1_46_S709 | A | A1 | | 112 | 84 | 28 |
| SERPINH1_8_S709 | U | A2 | | 103 | 90 | 39 |
| SERPINH1_85_S709 | C | A1 | | 166 | 109 | 59 |
| SERPINH1_45_S709 | U | A2 | 0.029 | | | |
| SERPINH1_45a_S1354 | A | A2 | 0.051 | | | | siRNA Knock Down Activity:

About $2 \times 10^5$ human PC-3 cells endogenously expressing SERPINH1 gene were seeded per well in 6 well plates and allowed to grow for about 24 hr to 30-70% confluency. Cells were transfected with the siRNAs being tested at different concentrations using the Lipofectamine™2000 reagent (Invitrogen). The cells were incubated at 37° C. in a 5% CO$_2$ incubator for either 48 h or 72 h. At 48-72 h after transfection cells were harvested and cell RNA was extracted. Cy3-labeled siRNA duplexes were used as a positive control for transfection efficiency. Mock cells treated with Lipofectamine™2000 reagent defined as "Control not active samples" (negative control) and cells treated with a known active siRNA (HSP47-C) at final concentration of 5 nM defined as "Control active samples" (positive control). Z' and controls fold {Fold=mean (Negative)/mean (Positive)} are the means to describe the assay efficiency.

The percent inhibition of target gene expression by each siRNA tested was determined by Qpcr analysis of a target mRNA from cells. Reverse transcription was performed by synthesizing cDNA from the cells and determining target gene mRNA levels by Real Time qPCR. Measured cell mRNA levels were normalized to those of the Cyclophilin A (CYNA, PPIA) mRNA for each sample. siRNA activity was determined based on the ratio of the target gene mRNA quantity siRNA-treated samples versus non-transfected control samples. Z' and controls fold {Fold=mean (Negative)/mean (Positive)} are the means to describe the assay efficiency.

The qPCR results are those that passed QC standards, i.e. the value of the standard curve slope was in the interval [−4, −3], R2>0.99, no primer dimers. Results that did not pass the QC requirements were disqualified from analysis.

IC50 value of the tested RNAi activity was determined by constructing a dose-response curve using the activity results obtained with the various final siRNA concentrations. The dose response curve was constructed by plotting the relative amount of residual SERPINH1 mRNA versus the logarithm of transfected siRNA concentration, as described above.

On-Target and Off-Target Testing of Double Stranded RNA Molecules:

The psiCHECK system enables evaluation of the guide strand (GS) (antisense) and the passenger strand (PS) (sense strand) to elicit targeted (on-target) and off-targeted effects, by monitoring the changes in expression levels of their target sequences. Four psiCHECK™-2-based (Promega) constructs were prepared for the evaluation of target activity and potential off-target activity of each test molecule GS and PS strands. In each of the constructs one copy or three copies of either the full target or the seed-target sequence, of test molecule PS or GS, was cloned into the multiple cloning site located downstream of the Renilla luciferase translational stop codon in the 3'-UTR region.

The resulting vectors were termed:

1—GS-CM (guide strand, complete-match) vector containing one copy of the full target sequence (nucleotide sequence fully complementary to the whole 19-base sequence of the GS of the test molecule);

2—PS-CM (passenger strand, complete-match) vector containing one copy of the full target sequence (nucleotide sequence fully complementary to the whole 19-base sequence of the PS of the test molecule);

3—GS-SM (guide strand, seed-match) vector containing one copy or three copies of the seed region target sequence (sequence complementary to nucleotides 1-8 of the GS of the test molecule);

4—PS-SM (passenger strand, seed-match) vector containing one copy of the seed region target sequence (sequence complementary to nucleotides 1-8 of the PS of the test molecule).

Nomenclature:

guide strand: strand of siRNA that enters the RISC complex and guides cleavage/silencing of the complementary RNA sequence seed sequence: Nucleotides 2-8 from the 5' end of the guide strand.

cm (complete match): DNA fragment fully complementary to the guide strand of siRNA. This DNA fragment is cloned in 3'UTR of a reporter gene and serves as a target for the straightforward RNA silencing.

sm (seed match): 19-mer DNA fragment with nucleotides ns 12-18 fully complementary to the ns 2-8 of the guide strand of siRNA. This DNA fragment is cloned in 3'UTR of a reporter gene and serves as a target for the "off-target" silencing.

X1: A single copy of cm or sm cloned in 3'UTR of a reporter gene.

X3 Three copies of cm or sm cloned in 3'UTR of a reporter gene, separated with 4 nucleotides one from another.

TABLE 4 non-limiting examples of psiCHECK cloning targets

| Nomenclature | Description | structure |
|---|---|---|
| S2a_cm_X1 clone name | SERPINH1_2, antisense complete match = fully complimentary to the SERPINH1_2 antisense strand, a single copy. | CTCGAGGAGACACATGGGTGCTATAG CGGCCGC SEQ_ID_NO: 2724 XhoI SERPINH1_2 sense strand NotI |
| S2acmS_X1 | The sense strand = the strand of the S2a_cm_X1 clone to be expressed in the vector, with XhoI and NotI sticky ends. | 5'-TCGAGGAGACACATGGGTGCTATAGC SEQ_ID_NO: 2725 |
| S2acmA_X1 | The complimentary (antisense) strand of the S2a_cm_X1 clone, with XhoI and NotI sticky ends. | 5'-GGCCGCTATAGCACCCATGTGTCTCC SEQ_ID_NO: 2726 |
| S2a_sm_X1 clone name | SERPINH1_2, antisense seed match, a single copy, nucleotides 12-18 are complimentary to the nucleotides 2-8 of the SERPINH1_2 antisense strand. | CTCGAGTCTCAAACGTTGTGCTATCG CGGCCGC SEQ_ID_NO: 2727 AS(3'-CTCTGTGTACCCACGATAT) SEQ_ID_NO: 2728 seed |
| S2s_cm_X1 clone name | SERPINH1_2, sense complete match = fully complimentary to the SERPINH1_2 sense strand = antisense strand, a single copy. | CTCGAGTATAGCACCCATGTGTCTCG CGGCCGC SEQ_ID_NO: 2729 XhoI SERPINH1_2 antisense strand NotI |
| S2s_sm_X1 clone name | SERPINH1_2, sense seed match, a single copy, nucleotides 12-18 are complimentary to the nucleotides 2-8 of the SERPINH1_2 sense strand. | CTCGAGGCGATACAAACTGTGTCTAG CGGCCGC SEQ_ID_NO: 2730 S(3'-ATATCGTGGGTACACAGAG) SEQ_ID_NO: 2731 seed |
| S2a_sm_X3 clone name | SERPINH1_2, antisense seed match, a triple copy | CTCGAGTCTCAAACGTTGTGCTATCttc cTCTCAAACGTTGTGCTATCttccTCTCA AACGTTGTGCTATCGCGGCCGC SEQ_ID_NO: 2732 (ttcc - a spacer) |
| Sts_sm_X3 clone name | SERPINH1_2, sense seed match, a triple copy | CTCGAGGCGATACAAACTGTGTCTAtt ccGCGATACAAACTGTGTCTAttccGCG ATACAAACTGTGTCTAGCGGCCGC SEQ_ID_NO: 2733 (ttcc - a spacer) |

The target sequences are cloned using the XhoI and NotI compatible restriction enzyme sites. Annealing mixtures are prepared in tightly closed 0.5 ml Eppendorf tubes, heated in a water bath to 850 C, submerged into the boiling water bath and finally gradually cooled to room temperature.

Ligation: The double stranded oligonucleotide generated by the annealing procedure is ligated to the linearized (by XhoI and NotI) psiCHECK™-2, and transfected into cells using standard techniques. Positive colonies were identified and sequenced for verification of insert sequence. Table 5 shows nucleotide sequences of inserted oligonucleotides.

TABLE 5

| siRNA | Clone Full name | SEQ ID NO: | Oligonucleotide sequence (5'>3') |
|---|---|---|---|
| SERPINH1_11 | S11s_cm_X1 | 2734 | GGCCGCCGGACAGGCCTCTACAACAC |
|  |  | 2735 | TCGAGTGTTGTAGAGGCCTGTCCGGC |
|  | S11a_cm_X1 | 2736 | GGCCGCTGTTGTAGAGGCCTGTCCGC |
|  |  | 2737 | TCGAGCGGACAGGCCTCTACAACAGC |
|  | S11s_sm_X1 | 2738 | GGCCGCAGGACAGGAAGAGCACCACC |
|  |  | 2739 | TCGAGGTGGTGCTCTTCCTGTCCTGC |
|  | S11a_sm_X1 | 2740 | GGCCGCGGTTGTAGCTTAAGGGAATC |
|  |  | 2741 | TCGAGATTCCCTTAAGCTACAACCGC |
|  | S11s_sm_X3 | 2742 | GGCCGCAGGACAGGAAGAGCACCACGGAAAGGACAG GAAGAGCACCACGGAAAGGACAGGAAGAGCACCACC |
|  |  | 2743 | TCGAGGTGGTGCTCTTCCTGTCCTTTCCGTGGTGCTCT TCCTGTCCTTTCCGTGGTGCTCTTCCTGTCCTGC |

TABLE 5-continued

| siRNA | Clone Full name | SEQ ID NO: | Oligonucleotide sequence (5'>3') |
|---|---|---|---|
| | S11a_sm_X3 | 2744 | GGCCGCGGTTGTAGCTTAAGGGAATGGAAGGTTGTAGCTTAAGGGAATGGAAGGTTGTAGCTTAAGGGAATC |
| | | 2745 | TCGAGATTCCCTTAAGCTACAACCTTCCATTCCCTTAAGCTACAACCTTCCATTCCCTTAAGCTACAACCGC |
| SERPINH1_30 | S30s_cm_X1 | 2746 | GGCCGCCGGACAGGCCTCTACAACTC |
| | | 2747 | TCGAGAGTTGTAGAGGCCTGTCCGGC |
| | S30a_cm_X1 | 2748 | GGCCGCAGTTGTAGAGGCCTGTCCGC |
| | | 2749 | TCGAGCGGACAGGCCTCTACAACTGC |
| SERPINH1_2 | S2s_cm_X1 | 2750 | GGCCGCGAGACACATGGGTGCTATAC |
| | | 2751 | TCGAGTATAGCACCCATGTGTCTCGC |
| | S2a_cm_X1 | 2752 | GGCCGCTATAGCACCCATGTGTCTCC |
| | | 2753 | TCGAGGAGACACATGGGTGCTATAGC |
| | S2s_sm_X1 | 2754 | GGCCGCTAGACACAGTTTGTATCGCC |
| | | 2755 | TCGAGGCGATACAAACTGTGTCTAGC |
| | S2a_sm_X1 | 2756 | GGCCGCGATAGCACAACGTTTGAGAC |
| | | 2757 | TCGAGTCTCAAACGTTGTGCTATCGC |
| | S2s_sm_X3 | 2758 | GGCCGCTAGACACAGTTTGTATCGCGGAATAGACACAGTTTGTATCGCGGAATAGACACAGTTTGTATCGCC |
| | | 2759 | TCGAGGCGATACAAACTGTGTCTATTCCGCGATACAAACTGTGTCTATTCCGCGATACAAACTGTGTCTAGC |
| | S2a_sm_X3 | 2760 | GGCCGCGATAGCACAACGTTTGAGAGGAAGATAGCACAACGTTTGAGAGGAAGATAGCACAACGTTTGAGAC |
| | | 2761 | TCGAGTCTCAAACGTTGTGCTATCTTCCTCTCAAACGTTGTGCTATCTTCCTCTCAAACGTTGTGCTATCGC |
| SERPINH1_4 | S4s_cm_X1 | 2762 | GGCCGCGAGACACATGGGTGCTATTC |
| | | 2763 | TCGAGAATAGCACCCATGTGTCTCGC |
| | S4a_cm_X1 | 2764 | GGCCGCAATAGCACCCATGTGTCTCC |
| | | 2765 | TCGAGGAGACACATGGGTGCTATTGC |
| SERPINH1_6 | S6s_cm_X1 | 2766 | GGCCGCACAAGATGCGAGACGAGTAC |
| | | 2767 | TCGAGTACTCGTCTCGCATCTTGTGC |
| | S6a_cm_X1 | 2768 | GGCCGCTACTCGTCTCGCATCTTGTC |
| | | 2769 | TCGAGACAAGATGCGAGACGAGTAGC |
| | S6s_sm_X1 | 2770 | GGCCGCCCAAGATGATCTAATCTGCC |
| | | 2771 | TCGAGGCAGATTAGATCATCTTGGGC |
| | S6a_sm_X1 | 2772 | GGCCGCGACTCGTCGATACTAGGTGC |
| | | 2773 | TCGAGCACCTAGTATCGACGAGTCGC |
| | S6s_sm_X3 | 2774 | TCGAGGCAGATTAGATCATCTTGGTTCCGCAGATTAGATCATCTTGGTTCCGCAGATTAGATCATCTTGGGC |
| | | 2775 | GGCCGCCCAAGATGATCTAATCTGCGGAACCAAGATGATCTAATCTGCGGAACCAAGATGATCTAATCTGCC |
| | S6a_sm_X3 | 2776 | GGCCGCGACTCGTCGATACTAGGTGGGAAGACTCGTCGATACTAGGTGGGAAGACTCGTCGATACTAGGTGC |
| | | 2777 | TCGAGCACCTAGTATCGACGAGTCTTCCCACCTAGTATCGACGAGTCTTCCCACCTAGTATCGACGAGTCGC |
| SERPINH1_12 | S12s_cm_X1 | 2778 | GGCCGCACAAGATGCGAGACGAGTTC |
| | | 2779 | TCGAGAACTCGTCTCGCATCTTGTGC |
| | S12a_cm_X1 | 2780 | GGCCGCAACTCGTCTCGCATCTTGTC |
| | | 2781 | TCGAGACAAGATGCGAGACGAGTTGC |
| SERPINH1_45a | S450s_cmX1 | 2782 | GGCCGCACTCCAAGATCAACTTCCTC |
| | | 2783 | TCGAGAGGAAGTTGATCTTGGAGTGC |
| (SERPINH1_45_S450) | S450a_cmX1 | 2784 | GGCCGCAGGAAGTTGATCTTGGAGTC |
| | | 2785 | TCGAGACTCCAAGATCAACTTCCTGC |
| | S450s_smX1 | 2786 | GGCCGCCCTCCAAGCGACCATGAAGC |
| | | 2787 | TCGAGCTTCATGGTCGCTTGGAGGGC |
| | S450a_smX1 | 2788 | GGCCGCCGGAAGTTTCGATGTTCTGC |
| | | 2789 | TCGAGCAGAACATCGAAACTTCCGGC |
| | S450s_smX3 | 2790 | GGCCGCCCTCCAAGCGACCATGAAGGGAACCTCCAAGCGACCATGAAGGGAACCTCCAAGCGACCATGAAGC |
| | | 2791 | TCGAGCTTCATGGTCGCTTGGAGGTTCCCTTCATGGTCGCTTGGAGGTTCCCTTCATGGTCGCTTGGAGGGC |
| | S450a_smX3 | 2792 | GGCCGCCGGAAGTTTCGATGTTCTGGGAACGGAAGTTTCGATGTTCTGGGAACGGAAGTTTCGATGTTCTGC |
| | | 2793 | TCGAGCAGAACATCGAAACTTCCGTTCCCAGAACATCGAAACTTCCGTTCCCAGAACATCGAAACTTCCGGC |
| SERPINH1_51 | S51s_cm_X1 | 2794 | GGCCGCTCCTGAGACACATGGGTGAC |
| | | 2795 | TCGAGTCACCCATGTGTCTCAGGAGC |
| | S51a_cm_X1 | 2796 | GGCCGCTCACCCATGTGTCTCAGGAC |
| | | 2797 | TCGAGTCCTGAGACACATGGGTGAGC |

TABLE 5-continued

| siRNA | Clone Full name | SEQ ID NO: | Oligonucleotide sequence (5'>3') |
|---|---|---|---|
| | S51s_sm_X1 | 2798 | GGCCGCGCCTGAGAACACGTGTGTCC |
| | | 2799 | TCGAGGACACACGTGTTCTCAGGCGC |
| | S51a_sm_X1 | 2800 | GGCCGCGCACCCATTGTGATACTTCC |
| | | 2801 | TCGAGGAAGTATCACAATGGGTGCGC |
| | S51s_sm_X3 | 2802 | GGCCGCGCCTGAGAACACGTGTGTCGGAAGCCTGAGAACACGTGTGTCGGAAGCCTGAGAACACGTGTGTCC |
| | | 2803 | TCGAGGACACACGTGTTCTCAGGCTTCCGACACACGTGTTCTCAGGCTTCCGACACACGTGTTCTCAGGCGC |
| | S51a_sm_X3 | 2804 | GGCCGCGCACCCATTGTGATACTTCGGAAGCACCCATTGTGATACTTCGGAAGCACCCATTGTGATACTTCC |
| | | 2805 | TCGAGGAAGTATCACAATGGGTGCTTCCGAAGTATCACAATGGGTGCTTCCGAAGTATCACAATGGGTGCGC |
| SERPINH1_86 | S86s_cm_X1 | 2806 | GGCCGCACAGGCCTCTACAACTACAC |
| | | 2807 | TCGAGTGTAGTTGTAGAGGCCTGTGC |
| | S86a_cm_X1 | 2808 | GGCCGCTGTAGTTGTAGAGGCCTGTC |
| | | 2809 | TCGAGACAGGCCTCTACAACTACAGC |
| | S86s_sm_X1 | 2810 | GGCCGCACAGGCCTAGCACAAGCACC |
| | | 2811 | TCGAGGTGCTTGTGCTAGGCCTGTGC |
| | S86a_sm_X1 | 2812 | GGCCGCGGTAGTTGGCTCTGAAGTGC |
| | | 2813 | TCGAGCACTTCAGAGCCAACTACCGC |
| | S86s_sm_X3 | 2814 | GGCCGCACAGGCCTAGCACAAGCACGGAAACAGGCCTAGCACAAGCACGGAAACAGGCCTAGCACAAGCACC |
| | | 2815 | TCGAGGTGCTTGTGCTAGGCCTGTTTCCGTGCTTGTGCTAGGCCTGTTTCCGTGCTTGTGCTAGGCCTGTGC |
| | S86a_sm_X3 | 2816 | GGCCGCGGTAGTTGGCTCTGAAGTGGGAAGGTAGTTGGCTCTGAAGTGGGAAGGTAGTTGGCTCTGAAGTGC |
| | | 2817 | TCGAGCACTTCAGAGCCAACTACCTTCCCACTTCAGAGCCAACTACCTTCCCACTTCAGAGCCAACTACCGC |
| SERPINH1_52 | S52s_cm_X1 | 2818 | GGCCGCGACAAGATGCGAGACGAGAC |
| | | 2819 | TCGAGTCTCGTCTCGCATCTTGTCGC |
| | S52a_cm_X1 | 2820 | GGCCGCTCTCGTCTCGCATCTTGTCC |
| | | 2821 | TCGAGGACAAGATGCGAGACGAGAGC |
| | S52s_sm_X1 | 2822 | GGCCGCTACAAGATTATCTCATCTCC |
| | | 2823 | TCGAGGAGATGAGATAATCTTGTAGC |
| | S52a_sm_X1 | 2824 | GGCCGCGCTCGTCTATACTAGGTGAC |
| | | 2825 | TCGAGTCACCTAGTATAGACGAGCGC |
| | S52s_sm_X3 | 2826 | GGCCGCTACAAGATTATCTCATCTCGGAATACAAGATTATCTCATCTCGGAATACAAGATTATCTCATCTCC |
| | | 2827 | TCGAGGAGATGAGATAATCTTGTATTCCGAGATGAGATAATCTTGTATTCCGAGATGAGATAATCTTGTAGC |
| | S52a_sm_X3 | 2828 | GGCCGCGCTCGTCTATACTAGGTGAGGAAGCTCGTCTATACTAGGTGAGGAAGCTCGTCTATACTAGGTGAC |
| | | 2829 | TCGAGTCACCTAGTATAGACGAGCTTCCTCACCTAGTATAGACGAGCTTCCTCACCTAGTATAGACGAGCGC |
| SERPINH1_58 | S58s_cm_X1 | 2830 | GGCCGCGACAAGATGCGAGACGAGTC |
| | | 2831 | TCGAGACTCGTCTCGCATCTTGTCGC |
| | S58a_cm_X1 | 2832 | GGCCGCACTCGTCTCGCATCTTGTCC |
| | | 2833 | TCGAGGACAAGATGCGAGACGAGTGC |
| SERPINH1_95 | S95s_cm_X1 | 2834 | GGCCGCACTCCAAGATCAACTTCCGC |
| | | 2835 | TCGAGCGGAAGTTGATCTTGGAGTGC |
| | S95a_cm_X1 | 2836 | GGCCGCCGGAAGTTGATCTTGGAGTC |
| | | 2837 | TCGAGACTCCAAGATCAACTTCCGGC |
| SERPINH1_96 | S96s_cm_X1 | 2838 | GGCCGCTCCTGAGACACATGGGTGCC |
| | | 2839 | TCGAGGCACCCATGTGTCTCAGGAGC |
| | S96a_cm_X1 | 2840 | GGCCGCGCACCCATGTGTCTCAGGAC |
| | | 2841 | TCGAGTCCTGAGACACATGGGTGCGC |
| SERPINH1_97 | S97s_cm_X1 | 2842 | GGCCGCACAGGCCTCTACAACTACTC |
| | | 2843 | TCGAGAGTAGTTGTAGAGGCCTGTGC |
| | S97a_cm_X1 | 2844 | GGCCGCAGTAGTTGTAGAGGCCTGTC |
| | | 2845 | TCGAGACAGGCCTCTACAACTACTGC |

Relevant strands, as described above, were cloned in the 3'UTR of the reporter mRNA, Renilla Luciferase in the psiCHECK™-2 (Promega) vector. XhoI and NotI were used as cloning sites using standard molecular biology techniques. Each strand was chemically synthesized and annealed by heating to 100° C. and cooled to room temperature. Ligation was carried out for 3 hours using standard molecular biology techniques and transformed into E. coli DH5a cells. Resulting colonies were screened for presence of plasmid constructs by colony-PCR using relevant primers. Each of the plasmids (vectors) was purified from one positive colony and its sequence was verified.

About $1.3 \times 10^6$ human HeLa cells were inoculated in 10 cm dish. Cells were then incubated in 37±1° C., 5% CO2 incubator for 24 hours. Growth medium was replaced one day post inoculation by 8 mL fresh growth medium and each plate was transfected with one of the plasmids mentioned above, using Lipofectamine™2000 reagent according manufacturing protocol and incubated for 5 hours at 37±1° C. and 5% CO2. Following incubation, cells were re-plated in a 96-well plate at final concentration of 5×103 cells per well in 80 μL growth medium. 16 hours later, cells were transfected with SERPINH1 siRNA molecules using Lipofectamine™2000 reagent at different concentrations ranging from 0.001 nM to 5 nM in a 1000 μL final volume. Mock cells treated with Lipofectamine™2000 reagent with the corresponding psiCHECK™-2 plasmid defined as "Control not active samples" (negative control) and cells treated with a known active siRNA (HSP47-C) at final concentration of 5 nM defined as "Control active samples" (positive control). Z' and controls fold {Fold=mean (Negative)/mean(Positive)} are the means to describe the assay efficiency.

Cells were then incubated for 48 hours at 37±1° C. and Renilla and FireFly Luciferase activities were measured in each of the siRNA transfected samples, using Dual-Luciferase® Assay kit (Promega, Cat#E1960) according to manufacturer procedure. The activity of a synthetic siRNA toward this target sequence results either in cleavage and subsequent degradation of the fused mRNA or in translation inhibition of the encoded protein. Measuring the decrease in Renilla luciferase activity thus provides a convenient way of monitoring siRNA effect while Firefly luciferase, allows normalization of Renilla luciferase expression. Renilla Luciferase activity value was divided by Firefly Luciferase activity value for each sample (normalization). Renilla luciferase activity is finally expressed as the percentage of the normalized activity value in tested sample relative to "Control not active samples".

Results of TNFα and IL-6 levels in peripheral blood mononuclear cells (PMNC) exposed to unmodified or modified siRNA/Lipofectamine™2000. Results are provided in pg/ml values calculated based on standard curve. "Control Lipofec2000" relates to level of cytokine secretion induced by the transfection reagent, Lipofectamine™2000. None of the modified compounds levels of cytokines TNFa or IL6 above those of the control transfection reagent.

|  |  | Donor II | |
|---|---|---|---|
|  |  | TNFa | IL-6 |
| control |  | 162 +/− 280 |  |
| Control Lipofec2000 |  | 308 +/− 75 | 1303 +/− 440 |
| dsRNA SEQ ID | 860 nM | 610 | 2915 |
| NOS: 101 and 168) | 287 nM | 6963 | 4021 |
| unmodified | 96 nM | 641 | 2278 |
|  | 32 nM | 1095 | 4126 |
| Compound_4 | 860 nM | 660 +/− 227 | 1166 +/− 280 |
|  | 287 nM | 484 +/− 84 | 1844 +/− 1072 |
|  | 96 nM | 571 +/− 170 | 2015 +/− 1667 |
|  | 32 nM | 865 +/− 90 | 2201 +/− 952 |

|  |  | Donor I | | Donor II | |
|---|---|---|---|---|---|
|  |  | TNFa | IL-6 | TNFa | IL-6 |
| control |  |  | 115 +/− 64 | 162 +/− 280 |  |
| control Lipofec2000 |  | 427 +/− 87 | 1848 +/− 194 | 308 +/− 75 | 1303 +/− 440 |
| dsRNA SEQ ID | 860 nM | 326 | 1014 | 873 | 4015 |
| NOS: 60 and 127) | 287 nM | 305 | 638 | 909 | 3046 |
| unmodified | 96 nM | 546 | 1007 | 690 | 2451 |
|  | 32 nM | 707 | 1331 | 637 | 2159 |
| Compound_1 | 860 nM | 491 | 1480 | 1017 | 4492 |
|  | 287 nM | 363 | 956 | 981 | 3126 |
|  | 96 nM | 294 | 840 | 952 | 2491 |
|  | 32 nM | 355 | 848 | 902 | 2779 |

|  |  | Donor I | |
|---|---|---|---|
|  |  | TNFa | IL-6 |
| control |  |  | 115 +/− 64 |
| control Lipofec2000 |  | 427 +/− 87 | 1848 +/− 194 |
| dsRNA SEQ ID | 860 nM | 228 | 553 |
| NOS: 63 and 130) | 287 nM | 395 | 569 |
| unmodified | 96 nM | 561 | 966 |
|  | 32 nM | 737 | 1021 |
| Compound_2 | 860 nM | 598 | 1560 |
|  | 287 nM | 621 | 1440 |
|  | 96 nM | 570 | 1825 |
|  | 32 nM | 517 | 1510 |

|  |  | Donor I | | Donor II | |
|---|---|---|---|---|---|
|  |  | TNFa | IL-6 | TNFa | IL-6 |
| control |  |  | 115 +/− 64 | 162 +/− 280 |  |
| control Lipofec2000 |  | 427 +/− 87 | 1848 +/− 194 | 308 +/− 75 | 1303 +/− 440 |
| dsRNA SEQ ID | 860 nM | 137 | 225 | 521 | 4223 |

| | | | | |
|---|---|---|---|---|
| NOS: 98 and 165) | 287 nM | 750 | 105 | 463 | 3755 |
| unmodified | 96 nM | 504 | 180 | 627 | 2784 |
| | 32 nM | 312 | 442 | 711 | 3084 |
| Compound_3 | 860 nM | 540 | 2170 | 1474 | 3896 |
| | 287 nM | 698 | 2428 | 1000 | 1864 |
| | 96 nM | 582 | 1876 | 1089 | 1760 |
| | 32 nM | 614 | 1341 | 724 | 1044 |
| Ctrl cells | | | 115 +/− 64 | 162 +/− 280 | |
| CL075 (ug/ml) | 2 | 13878 | | 26464 | |
| | 0.67 | 8115 | 28471 | 17013 | |
| | 0.22 | 1575 | 10873 | 7589 | 22111 |
| | 0.074 | 219 | 906 | 1389 | 7072 |

Results are pg/ml

Data for induction of interferon (IFN) responsive genes, MX1 and IFIT1, unmodified and modified double stranded nucleic acid compounds. Results shown are residual (fold of Ctrl Lipofectamine-2000 treated cells) human IFIT1 and MX1 genes as tested in human PMNC. Data shows that all modified compounds induced negligible levels of IFN downstream genes, compared to unmodified (_S709) compounds.

| | Donor II | |
|---|---|---|
| | IFIT1 | MX1 |
| Ctrl Lipo2000 | 1 | 1 |
| dsRNA SEQ ID NOS: 101 and 168) unmodified | | |
| 32 nM | 5.5 | 3.3 |
| 96 nM | 7.5 | 4.3 |
| 297 nM | 3.9 | 3.8 |
| 860 nM | 0.8 | 0.8 |
| Compound_4 | | |
| 32 nM | 1.2 +/− 0.5 | 1.7 +/− 0.35 |
| 96 nM | 1.1 +/− 0.3 | 1.5 +/− 0.06 |
| 297 nM | 0.7 +/− 0.3 | 0.9 +/− 0.7 |
| 860 nM | 0.6 +/− 0.1 | 0.9 +/− 0.5 |

| | Donor I | | Donor II | |
|---|---|---|---|---|
| | IFIT1 | MX1 | IFIT1 | MX1 |
| Ctrl Lipo2000 | 1 | 1 | 1 | 1 |
| dsRNA SEQ ID NOS: 60 and 127) unmodified | | | | |
| 32 nM | 27.9 | — | 2.2 | 2.7 |
| 96 nM | 42.1 | 18.3 | 4.0 | 5.0 |
| 297 nM | 53.8 | 18.0 | 3.4 | 2.8 |
| 860 nM | 39.4 | 16.3 | 3.3 | 3.6 |
| Compound_1 | | | | |
| 32 nM | 1.2 | 0.2 | 0.8 | 1.3 |
| 96 nM | 1.3 | 0.8 | 1.5 | 1.1 |
| 297 nM | 1.1 | 0.3 | 1.2 | 1.6 |
| 860 nM | 1.0 | 0.3 | 0.3 | 0.3 |
| Ctrl Lipo2000 | 1 | 1.00 | 1 | 1 |
| dsRNA SEQ ID NOS: 98 and 165) unmodified | | | | |
| 32 nM | 29.7 | 18.5 | 4.3 | 4.1 |
| 96 nM | 39.1 | 19.2 | 3.5 | |
| 297 nM | 25.1 | 9.3 | 4.8 | 5.2 |
| 860 nM | | | 3.8 | 3.7 |
| Compound_3 | | | | |
| 32 nM | 1.4 | 0.4 | 1.0 | 1.4 |
| 96 nM | 1.7 | 1.3 | 1.3 | 1.1 |
| 297 nM | 1.9 | 1.4 | 1.1 | 1.4 |
| 860 nM | 5.2 | 2.5 | 1.1 | 1.4 |

| | Donor I | |
|---|---|---|
| | IFIT1 | MX1 |
| Ctrl Lipo2000 | 1 | 1 |
| dsRNA SEQ ID NOS: 63 and 130) unmodified | | |
| 32 nM | 29.6 | 17.8 |
| 96 nM | 31.5 | 16.1 |
| 297 nM | | |
| 860 nM | 36.6 | 11.4 |
| Compound_2 | | |
| 32 nM | 1.6 | 0.7 |
| 96 nM | 1.1 | 1.0 |
| 297 nM | 2.1 | 0.2 |
| 860 nM | 1.8 | 1.4 |

| | Donor I | | Donor II | |
|---|---|---|---|---|
| | IFIT1 | MX1 | IFIT1 | MX1 |
| Ctrl cells | 1 | 1 | 1 | 1 |
| 0.125 | 18 | | 5.4 | 3.7 |
| 0.56 | 26 | 11 | 4.9 | 4.7 |
| 1.7 | 41 | 14 | 4.5 | 5.1 |
| 5 | 24 | 7 | 0.9 | 0.8 |
| 0.075 | 4 | 2 | 1.8 | 1.8 |
| 0.12 | 27 | 10 | 4.5 | 3.6 |
| 0.67 | 21 | | 4.6 | 4.2 |
| 2 | 26 | 12 | 4.1 | 3.7 |

The tables below show activity of Compound_1, Compound_2, Compound 3 and Compound_4 compared to unmodified (_S709) compounds in rat cells. Results are shown as residual target (% of control Lipofectamine™2000 treated cells) rat SERPINH1 gene in REF52 cells. Results of two separate experiments are shown. Knockdown to target gene in rat cells is relevant to testing compounds in animal models of human disease.

| | | Study_1 | Study_2 |
|---|---|---|---|
| Ctrl Lipo2000 | | 100 | 100 |
| dsRNA SEQ ID NOS: 60 and 127) unmodified | 0.8 nM | 52 | 36 |
| | 2 nM | 25 | 31 |
| | 10 nM | 16 | 28 |
| | 50 nM | 8 | 4 |
| Compound_1 | 0.8 nM | 53 | 14 |
| | 2 nM | 39 | 14 |
| | 10 nM | 19 | 24 |
| | 50 nM | 7 | 4 |
| dsRNA SEQ ID NOS: 63 and 130) unmodified | 0.8 nM | 45 | 15 |
| | 2 nM | 28 | 18 |
| | 10 nM | 13 | 12 |
| | 50 nM | 12 | 8 |

-continued

| | | | |
|---|---|---|---|
| Compound_2 | 0.8 nM | 76 | 78 |
| | 2 nM | 61 | 68 |
| | 10 nM | 37 | 28 |
| | 50 nM | | 4 |
| dsRNA SEQ ID NOS: 98 and 165) unmodified | 0.8 nM | 72 | 65 |
| | 2 nM | 43 | 41 |
| | 10 nM | 32 | 42 |
| | 50 nM | 28 | 27 |
| Compound_3 | 0.8 nM | 88 | 30 |
| | 2 nM | 39 | 24 |
| | 10 nM | 24 | 23 |
| | 50 nM | 6 | 23 |

| | | Study_3 | Study_4 |
|---|---|---|---|
| | Ctrl Lipo2000 | 100 | 100 |
| Compound_4 | 0.8 nM | 66 | 106 |
| | 2 nM | 35 | 32 |
| | 10 nM | 10 | 12 |
| | 50 nM | 6 | 9 |

Serum Stability Assay

The modified compounds according to the present invention are tested for duplex stability in human serum or human tissue extract, as follows:

siRNA molecules at final concentration of 7 uM are incubated at 370 C in 100% human serum (Sigma Cat# H4522). (siRNA stock 100 uM diluted in human serum 1:14.29 or human tissue extract from various tissue types). Five ul (5 ul) are added to 15 ul 1.5×TBE-loading buffer at different time points (for example 0, 30 min, 1 h, 3 h, 6 h, 8 h, 10 h, 16 h and 24 h). Samples were immediately frozen in liquid nitrogen and kept at −20° C.

Each sample is loaded onto a non-denaturing 20% acrylamide gel, prepared according to methods known in the art. The oligos were visualized with ethidium bromide under UV light.

Exonuclease Stability Assay

To study the stabilization effect of 3' non-nucleotide moieties on a nucleic acid molecule the sense strand, the antisense strand and the annealed siRNA duplex are incubated in cytosolic extracts prepared from different cell types.
Extract: HCT116 cytosolic extract (12 mg/ml).
Extract buffer: 25 mM Hepes pH-7.3 at 37° C.; 8 mM MgCl; 150 mM NaCl with 1 mM DTT was added fresh immediately before use.

Method: 3.5 ml of test siRNA (100 mM), were mixed with 46.5 ml contain 120 mg of HCT116 cytosolic extract. The 46.5 ml consists of 12 ml of HCT116 extract, and 34.5 ml of the extract buffer supplemented with DTT and protease inhibitors cocktail/100 (Calbiochem, setIII-539134). The final concentration of the siRNA in the incubation tube is 7 mM. The sample was incubated at 37° C., and at the indicated time point 5 ml were moved to fresh tube, mixed with 15 ml of 1×TBE-50% Glycerol loading buffer, and snap frozen in Liquid N2. The final concentration of the siRNA in the loading buffer is 1.75 mM (21 ng siRNA/ml). For Analyses by native PAGE and EtBr staining 50 ng are loaded per lane. For Northern analyses 1 ng of tested siRNA was loaded per lane.

Innate Immune Response to SERPINH1 siRNA Molecules:

Fresh human blood (at RT) was mixed at 1:1 ratio with sterile 0.9% NaCl at RT, and gently loaded (1:2 ratio) on Ficoll (Lymphoprep, Axis-Shield cat#1114547). Samples were centrifuged at RT (22° C., 800 g) in a swinging centrifuge for 30 minutes, washed with RPMI1640 medium and centrifuged (RT, 250 g) for 10 minutes. Cells were counted and seeded at final concentration of $1.5 \times 10^6$ cell/ml in growth medium (RPMI1640+10% FBS+2 mM L-glutamine+1% Pen-Strep) and incubated for 1 hours at 37° C. before siRNA treatment.

Cells were then treated with the siRNAs being tested at different concentrations using the Lipofectamine™2000 reagent (Invitrogen) according manufacturer's instructions and incubated at 37° C. in a 5% CO2 incubator for 24 hours.

As a positive control for IFN response, cells were treated with either poly(I:C), a synthetic analog of double strand RNA (dsRNA) which is a TLR3 ligand (InvivoGen Cat# tlr1-pic) at final concentrations of 0.25-5.0 μg/mL or to Thiazolaquinolone (CLO75), a TLR 7/8 ligand (InvivoGen Cat# tlr1-c75) at final concentrations of 0.075-2 μg/mL. Cell treated with Lipofectamine™2000 reagent were used as negative (reference) control for IFN response.

At about 24 hours following incubation, cells were collected and supernatant was transferred to new tubes. Samples were frozen immediately in liquid nitrogen and secretion of IL-6 and TNF-α cytokines was tested using IL-6, DuoSet ELISA kit (R&D System DY2060), and TNF-α, DuoSet ELISA kit (R&D System DY210), according to manufacturer's instructions. RNA was extracted from the cell pellets and mRNA levels of human genes IFIT1 (interferon-induced protein with tetratricopeptide repeats 1) and MX1 (myxovirus (influenza virus) resistance 1, interferon-inducible protein p78) were measured by qPCR. Measured mRNA quantities were normalized to the mRNA quantity of the reference gene peptidylprolyl isomerase A (cyclophilin A; CycloA). Induction of IFN-signaling was evaluated by comparing the quantity of mRNA from IFIT1 and MX1 genes from treated cells, relative to their quantities non-treated cells. The qPCR results are those that passed QC standards, i.e. the value of the standard curve slope was in the interval [−4, −3], R2>0.99, no primer dimers. Results that did not pass the QC requirements were disqualified from analysis.

Table 6 shows siSERPINH1 compounds. Activity and stability data for some of the compounds is presented in Table 6. The code for the sense and antisense strand structures is presented in Table 7, infra.

TABLE 6

| 1. Name | Stability in plasma (h) | % residual 5 nM 001 | 002 | % residual 25 nM 003 | 004 | 006 | Sense strand 5->3 code | AntiSense strand 5->3 code |
|---|---|---|---|---|---|---|---|---|
| SERPINH1_2_S1356 | 10 | 16 | 10 | 9 | | | zidB; rG; rA; rG; rA; rC; rA; rC; rA; rU; rG; rG; rG; rU; rG; rC2p; rU2p; rA2p; rU2p; rA2p | mU; rA; mU; rA; mG; rC; mA; rC; mC; rC; mA; rU; mG; rU; mG; rU; mC; rU; mC; zc3p; zc3p$ |
| SERPINH1_2_S1357 | | | | | | | zidB; rG; rA; rG; rA; rC; rA; rC; rA; rU; rG; rG; rG; rU; rG; rC2p; rU2p; rA2p; rU2p; rA2p | mU; rA; mU; rA; rG; mC; rA; mC; mC; mC; rA; mU; rG; mU; rG; mU; mC; mU; rC; zc3p; zc3p$ |

TABLE 6-continued

| 1. Name | Stability in plasma (h) | % residual 5 nM 001 | % residual 5 nM 002 | % residual 25 nM 003 | % residual 25 nM 004 | 006 | Sense strand 5->3 code | AntiSense strand 5->3 code |
|---|---|---|---|---|---|---|---|---|
| SERPINH1_2_S1358 | 16 | 52 | 41 | | | | zidB; rG; rA; rG; rA; rC; rA; rC; rA; rU; rG; rG; rG; rU; rG; rC2p; rU2p; rA2p; rU2p; rA2p | mU; rA; mU; rA; rG; mC; rA; mC; mC; rC; rA; mU; rG; mU; rG; mU; mC; mU; rC; zc3p; zc3p$ |
| SERPINH1_2_S1359 | | | | | | | zidB; rG; rA; rG; rA; rC; rA; rC; rA; rU; rG; rG; rG; rU; rG; rC2p; rU2p; rA2p; rU2p; rA2p | mU; rA; mU; rA; rG; mC; rA; mC; mC; rC; rA; mU; rG; mU; rG; rU; mC; rU; mC; zc3p; zc3p$ |
| SERPINH1_2_S1360 | 10 | 47 | 31 | 8 | 20 | | zidB; rG; rA; rG; rA; rC; rA; rC; rA; rU; rG; rG; rG; rU; rG; rC2p; rU2p; rA2p; rU2p; rA2p | mU; rA; mU; rA; rG; mC; rA; mC; rC; mC; rA; mU; rG; mU; rG; rU; mC; mU; rC; zc3p; zc3p$ |
| SERPINH1_2_S1361 | 8 | 31 | 34 | | | | zidB; rG; rA; rG; rA; rC; rA; rC; rA; rU; rG; rG; rG; rU; rG; rC2p; rU2p; rA2p; rU2p; rA2p | mU; rA; mU; rA; rG; rC2p; rA; mC; mC; rC; rA; mU; rG; mU; rG; rU; mC; rU; mC; zc3p; zc3p$ |
| SERPINH1_2_S1362 | | | | | | | zidB; rG; rA; rG; rA; rC; rA; rC; rA; rU; rG; rG; rG; rU; rG; rC2p; rU2p; rA2p; rU2p; rA2p | mU; rA; mU; rA; rG; LdC; rA; mC; mC; rC; rA; mU; rG; mU; rG; rU; mU; mC; rC; zc3p; zc3p$ |
| SERPINH1_2_S1363 | 17 | 10 | 15 | 25 | | | zc3p; rG; rA; rG; rA; rC; rA; rC; rA; rU; rG; rG; rG; rU; rG; rC2p; rU2p; rA2p; rU2p; rA2p | mU; rA; mU; rA; mG; rC; mA; rC; mC; rC; mA; rU; mG; rU; mG; rU; mC; rU; mC; zc3p; zc3p$ |
| SERPINH1_2_S1364 | | | | | | | zc3p; rG; rA; rG; rA; rC; rA; rC; rA; rU; rG; rG; rG; rU; rG; rC2p; rU2p; rA2p; rU2p; rA2p | mU; rA; mU; rA; rG; mC; rA; mC; mC; mC; rA; mU; rG; mU; rG; mU; mC; mU; rC; zc3p; zc3p$ |
| SERPINH1_2_S1365 | 16 | 41 | 52 | | | | zc3p; rG; rA; rG; rA; rC; rA; rC; rA; rU; rG; rG; rG; rU; rG; rC2p; rU2p; rA2p; rU2p; rA2p | mU; rA; mU; rA; rG; mC; rA; mC; rC; mC; rA; mU; rG; mU; rG; mU; mC; mU; rC; zc3p; zc3p$ |
| SERPINH1_2_S1366 | | | | | | | zc3p; rG; rA; rG; rA; rC; rA; rC; rA; rU; rG; rG; rG; rU; rG; rC2p; rU2p; rA2p; rU2p; rA2p | mU; rA; mU; rA; rG; mC; rA; mC; mC; rC; rA; mU; rG; mU; rG; rU; mC; rU; mC; zc3p; zc3p$ |
| SERPINH1_2_S1367 | 16 | 51 | 39 | | | | zc3p; rG; rA; rG; rA; rC; rA; rC; rA; rU; rG; rG; rG; rU; rG; rC2p; rU2p; rA2p; rU2p; rA2p | mU; rA; mU; rA; rG; mC; rA; mC; rC; mC; rA; mU; rG; mU; rG; rU; mC; mU; rC; zc3p; zc3p$ |
| SERPINH1_2_S1368 | | | | | | | zc3p; rG; rA; rG; rA; rC; rA; rC; rA; rU; rG; rG; rG; rU; rG; rC2p; rU2p; rA2p; rU2p; rA2p | mU; rA; mU; rA; rG; rC2p; rA; mC; mC; rC; rA; mU; rG; mU; rG; rU; mC; rU; mC; zc3p; zc3p$ |
| SERPINH1_2_S1369 | | | | | | | zc3p; rG; rA; rG; rA; rC; rA; rC; rA; rU; rG; rG; rG; rU; rG; rC2p; rU2p; rA2p; rU2p; rA2p | mU; rA; mU; rA; rG; LdC; rA; mC; mC; rC; rA; mU; rG; mU; rG; rU; mU; mC; rC; zc3p; zc3p$ |
| SERPINH1_2_S1370 | 17 | 15 | | 61 | 20 | | zidB; rG; rA; rG; rA; rC; rA; rC; rA; rU; rG; rG; rG; rU; rG; rC2p; rU2p; rA2p; rU2p; rA2p; zc3p$ | mU; rA; mU; rA; mG; rC; mA; rC; mC; rC; mA; rU; mG; rU; mG; rU; mC; rU; mC; zc3p; zc3p$ |
| SERPINH1_2_S1371 | | | | | | | zidB; rG; rA; rG; rA; rC; rA; rC; rA; rU; rG; rG; rG; rU; rG; rC2p; rU2p; rA2p; rU2p; rA2p; zc3p$ | mU; rA; mU; rA; rG; mC; rA; mC; mC; mC; rA; mU; rG; mU; rG; mU; mC; mU; rC; zc3p; zc3p$ |
| SERPINH1_2_S1372 | 16 | 74 | 66 | | | | zidB; rG; rA; rG; rA; rC; rA; rC; rA; rU; rG; rG; rG; rU; rG; rC2p; rU2p; rA2p; rU2p; rA2p; zc3p$ | mU; rA; mU; rA; rG; mC; rA; mC; rC; rA; mU; rG; mU; rG; mU; mC; mU; rC; zc3p; zc3p$ |
| SERPINH1_2_S1373 | 8 | 48 | 65 | | | | zidB; rG; rA; rG; rA; rC; rA; rC; rA; rU; rG; rG; rG; rU; rG; rC2p; rU2p; rA2p; rU2p; rA2p; zc3p$ | mU; rA; mU; rA; rG; mC; rA; mC; mC; rC; rA; mU; rG; mU; rG; rU; mC; rU; mC; zc3p; zc3p$ |
| SERPINH1_2_S1374 | 16 | 39 | 110 | 6 | | | zidB; rG; rA; rG; rA; rC; rA; rC; rA; rU; rG; rG; rG; rU; rG; rC2p; rU2p; rA2p; rU2p; rA2p; zc3p$ | mU; rA; mU; rA; rG; mC; rA; mC; rC; mC; rA; mU; rG; mU; rG; rU; mC; mU; rC; zc3p; zc3p$ |
| SERPINH1_2_S1375 | | | | | | | zidB; rG; rA; rG; rA; rC; rA; rC; rA; rU; rG; rG; rG; rU; rG; rC2p; rU2p; rA2p; rU2p; rA2p; zc3p$ | mU; rA; mU; rA; rG; rC2p; rA; mC; mC; rC; rA; mU; rG; mU; rG; rU; mC; rU; mC; zc3p; zc3p$ |
| SERPINH1_2_S1376 | | | | | | | zidB; rG; rA; rG; rA; rC; rA; rC; rA; rU; rG; rG; rG; rU; rG; rC2p; rU2p; rA2p; rU2p; rA2p; zc3p$ | mU; rA; mU; rA; rG; LdC; rA; mC; mC; rC; rA; mU; rG; mU; rG; rU; mC; rU; mC; zc3p; zc3p$ |
| SERPINH1_2_S1377 | 3 | | | 25 | 5 | | zidB; rG; rA; rG; rA; mC; rA; mC; rA; rU; rG; rG; rG; mU; rG; mC; mU; rA; LdT; rA$ | mU; rA; mU; rA; mG; rC; mA; rC; mC; rC; mA; rU; mG; rU; mG; rU; mC; rU; mC; zc3p; zc3p$ |
| SERPINH1_2_S1378 | | | | | | | zidB; rG; rA; rG; rA; mC; rA; mC; rA; rU; rG; rG; rG; mU; rG; mC; mU; rA; LdT; rA$ | mU; rA; mU; rA; rG; mC; rA; mC; mC; mC; rA; mU; rG; mU; rG; mU; mC; mU; rC; zc3p; zc3p$ |
| SERPINH1_2_S1379 | | | | | | | zidB; rG; rA; rG; rA; mC; rA; mC; rA; rU; rG; rG; rG; mU; rG; mC; mU; rA; LdT; rA$ | mU; rA; mU; rA; rG; mC; rA; mC; mC; rC; rA; mU; rG; mU; rG; mU; mU; mC; rC; zc3p; zc3p$ |
| SERPINH1_2_S1380 | 8 | 23 | 33 | | | | zidB; rG; rA; rG; rA; mC; rA; mC; rA; rU; rG; rG; rG; mU; rG; mC; mU; rA; LdT; rA$ | mU; rA; mU; rA; rG; mC; rA; mC; rC; mC; rA; mU; rG; mU; rG; rU; mC; mU; rC; zc3p; zc3p$ |
| SERPINH1_2_S1381 | 16 | 25 | 56 | 12 | | | zidB; rG; rA; rG; rA; mC; rA; mC; rA; rU; rG; rG; rG; mU; rG; mC; mU; rA; LdT; rA$ | mU; rA; mU; rA; rG; mC; rA; mC; rC; mC; rA; mU; rG; mU; rG; rU; mC; mU; rC; zc3p; zc3p$ |

TABLE 6-continued

| 1. Name | Stability in plasma (h) | % residual 5 nM 001 | % residual 5 nM 002 | % residual 25 nM 003 | % residual 25 nM 004 | 006 | Sense strand 5->3 code | AntiSense strand 5->3 code |
|---|---|---|---|---|---|---|---|---|
| SERPINH1_2_S1382 | 8 | 22 | 31 | 11 | | | zidB; rG; rA; rG; rA; mC; rA; mC; rA; rU; rG; rG; rG; mU; rG; mC; mU; rA; LdT; rA$ | mU; rA; mU; rA; rG; rC2p; rA; mC; mC; rC; rA; mU; rG; mU; rG; rU; mC; rU; mC; zc3p; zc3p$ |
| SERPINH1_2_S1383 | | | | | | | zidB; rG; rA; rG; rA; mC; rA; mC; rA; rU; rG; rG; rG; mU; rG; mC; mU; rA; LdT; rA$ | mU; rA; mU; rA; rG; LdC; rA; mC; mC; rC; rA; mU; rG; mU; rG; rU; mC; rU; mC; zc3p; zc3p$ |
| SERPINH1_2_S1384 | 16 | 7 | 20 | 7 | 4 | | zidB; rG; rA; rG; rA; mC; rA; mC; rA; rU; rG; rG; rG; mU; rG; rC; mU; rA; mU; rA; zc3p$ | mU; rA; mU; rA; mG; rC; mA; rC; mC; rC; mA; rU; mG; rU; mG; rU; mC; rU; mC; zc3p; zc3p$ |
| SERPINH1_2_S1385 | 16 | 55 | 37 | | | | zidB; rG; rA; rG; rA; mC; rA; mC; rA; rU; rG; rG; rG; mU; rG; rC; mU; rA; mU; rA; zc3p$ | mU; rA; mU; rA; rG; mC; rA; mC; mC; mC; rA; mU; rG; mU; rG; mU; mC; mU; rC; zc3p; zc3p$ |
| SERPINH1_2_S1386 | 16 | 42 | 45 | | | | zidB; rG; rA; rG; rA; mC; rA; mC; rA; rU; rG; rG; rG; mU; rG; rC; mU; rA; mU; rA; zc3p$ | mU; rA; mU; rA; rG; mC; rA; mC; mC; rC; rA; mU; rG; mU; rG; mU; mC; mU; rC; zc3p; zc3p$ |
| SERPINH1_2_S1387 | | | | | | | zidB; rG; rA; rG; rA; mC; rA; mC; rA; rU; rG; rG; rG; mU; rG; rC; mU; rA; mU; rA; zc3p$ | mU; rA; mU; rA; rG; mC; rA; mC; mC; rC; rA; mU; rG; mU; rG; rU; mC; rU; mC; zc3p; zc3p$ |
| SERPINH1_2_S1388 | 16 | 21 | 39 | | | | zidB; rG; rA; rG; rA; mC; rA; mC; rA; rU; rG; rG; rG; mU; rG; rC; mU; rA; mU; rA; zc3p$ | mU; rA; mU; rA; rG; mC; rA; mG; rC; rA; mC; rC; mC; rA; mU; rG; mU; rG; rU; mC; mU; rC; zc3p; zc3p$ |
| SERPINH1_2_S1389 | 16 | 20 | 27 | | | | zidB; rG; rA; rG; rA; mC; rA; mC; rA; rU; rG; rG; rG; mU; rG; rC; mU; rA; mU; rA; zc3p$ | mU; rA; mU; rA; rG; rC2p; rA; mC; mC; rC; rA; mU; rG; mU; rG; rU; mC; rU; mC; zc3p; zc3p$ |
| SERPINH1_2_S1390 | | | | | | | zidB; rG; rA; rG; rA; mC; rA; mC; rA; rU; rG; rG; rG; mU; rG; rC; mU; rA; mU; rA; zc3p$ | mU; rA; mU; rA; rG; LdC; rA; mC; mC; rC; rA; mU; rG; mU; rG; rU; mC; rU; mC; zc3p; zc3p$ |
| SERPINH1_2_S1687 | | | | | | | zidB; rG; rA; rG; rA; rC; rA; mC; rA; rU; rG; rG; rG; mU; rG; rC; mU; rA; mU; rA; zc3p$ | mU; rA; mU; rA; mG; rC; mA; rC; mC; rC; mA; rU; mG; rU; mG; rU; mC; rU; rC; zc3p; zc3p$ |
| SERPINH1_2_S1694 | 24 | | | | | | zidB; rG; rA; rG; rA; rC; rA; mC; rA; rU2p; rG; rG; rG; mU; rG; rC; mU; rA; mU; rA; zc3p$ | mU; rA; mU; rA; mG; rC; rA2p; rC; mC; rC; mA; rU; mG; rU; mG; rU; mC; rU; mC; zc3p; zc3p$ |
| SERPINH1_2_S1700 | 16 | | | | | | zidB; rG; rA; rG; rA; mC; rA; mC; rA; rU; rG; rG; rG; mU; rG; rC; mU; rA; rU2p; rA; zc3p$ | mU; rA; mU; rA; mG; rC; rA2p; rC; mC; rC; mA; rU; mG; rU; mG; rU; mC; rU; mC; zc3p; zc3p$ |
| SERPINH1_2_S1705 | 10 | | | | | | zidB; rG; rA; rG; rA; rC; rA; rC; rA; rU; rG; rG; rG; rU; rG; rC2p; rU2p; rA2p; rU2p; rA2p | mU; rA; mU; rA; mG; rC; rA2p; rC; mC; rC; mA; rU; mG; rU; mG; rU; mC; rU; mC; zc3p; zc3p$ |
| SERPINH1_2_S1707 | 10 | | | | | | zidB; rG; rA; rG; rA; rC; rA; rC; rA; rU; rG; rG; rG; rU; rG; rC2p; rU2p; rA2p; rU2p; rA2p; zc3p$ | mU; rA; mU; rA; mG; rC; rA2p; rC; mC; rC; mA; rU; mG; rU; mG; rU; mC; rU; mC; zc3p; zc3p$ |
| SERPINH1_2_S1754 | 24 | | | | | | zidB; rG; rA; rG; rA; rC; rA; rC; rA; rU; rG; rG; rG; rU; rG; rC2p; rU2p; rA2p; rU2p; rA2p; zc3p | mU; rA; mU; rA; mG; rC; rA2p; rC; mC; rC; mA; rU; mG; rU; mG; rU; mC; rU; mC; zc3p; zc3p$ |
| SERPINH1_2_S1755 | 24 | | | | | | zidB; rG; rA; rG; rA; rC; rA; rC; rA; rU; rG; rG; rG; rU; rG; rC2p; rU2p; rA2p; rU2p; rA2p; zc3p | rU2p; rA; mU; rA; mG; rC; rA2p; rC; mC; rC; mA; rU; mG; rU; mG; rU; mC; rU; mC; zc3p; zc3p$ |
| SERPINH1_2_S1756 | | | | | | | zidB; rG; rA; rG; rA; rC; rA; rC; rA; rU; rG; rG; rG; rU; rG; rC2p; rU2p; rA2p; rU2p; rA2p | rU2p; rA; mU; rA; mG; rC; rA2p; rC; mC; rC; mA; rU; mG; rU; mG; rU; mC; rU; mC; zc3p; zc3p$ |
| SERPINH1_2_S1787 | | | | | | | zidB; rG; rA; rG; rA; rC; rA; rC; rA; rU; rG; rG; rG; rU; rG; rC2p; rU2p; rA2p; rU2p; rA2p; zc3p | dU; rA; mU; rA; mG; rC; rA2p; rC; mC; rC; mA; rU; mG; rU; mG; rU; mC; rU; mC; zc3p; zc3p$ |
| SERPINH1_4_S1391 | 0 | | 58 | | | | zidB; rG; rA; rG; rA; rC; rA; rC; rA; rU; rG; rG; rG; rU; rG; rC2p; rU2p; rA2p; rU2p; rU2p | rA; mA; rU; mA; rG; mC; rA; mC; rC; rC; mA; rU; mG; rU; mG; rU; mC; rU; mC; zc3p$ |
| SERPINH1_4_S1782 | | | | | | | zidB; rG; rA; rG; rA; rC; rA; rC; rA; rU; rG; rG; rG; rU; rG; rC2p; rU2p; rA2p; rU2p; rU2p; zc3p | rA; rA; mU; rA; mG; rC; rA2p; rC; mC; rC; mA; rU; mG; rU; mG; rU; mC; rU; mC; zc3p; zc3p$ |
| SERPINH1_6_S1356 | | | | | | | zidB; rA; rC; rA; rA; rG; rA; rU; rG; rC; rG; rA; rG; rA; rC; rG2p; rA2p; rG2p; rU2p; rA2p | mU; rA; mU; rU; mC; rG; mU; rC; mU; rC; mG; rC; mA; rU; mC; rU; mU; rG; mU; zc3p$ |
| SERPINH1_6_S1363 | | | | | | | zc3p; rA; rC; rA; rA; rG; rA; rU; rG; rC; rG; rA; rG; rA; rC; rG2p; rA2p; rG2p; rU2p; rA2p | mU; rA; mC; rU; mC; rG; mU; rC; mU; rC; mG; rC; mA; rU; mC; rU; mU; rG; mU; zc3p$ |
| SERPINH1_6_S1370 | | | | | | | zidB; rA; rC; rA; rA; rG; rA; rU; rG; rC; rG; rA; rG; rA; rC; rG2p; rA2p; rG2p; rU2p; rA2p; zc3p$ | mU; rA; mC; rU; mC; rG; mU; rC; mU; rC; mG; rC; mA; rU; mC; rU; mU; rG; mU; zc3p$ |
| SERPINH1_6_S1414 | | | | | | | zc3p; rA; rC; rA; rA; rG; rA; rU; rG; rC; rG; rA; rG; rA; rC; rG2p; rA2p; rG2p; rU2p; rA2p | mU; rA; mC; mU; mC; rG; mU; mC; mU; mC; rG; mC; mA; mU; mC; mU; mU; rG; rU; zc3p; zc3p$ |

TABLE 6-continued

| 1. Name | Stability in plasma (h) | % residual 5 nM 001 | 002 | % residual 25 nM 003 | 004 | 006 | Sense strand 5->3 code | AntiSense strand 5->3 code |
|---|---|---|---|---|---|---|---|---|
| SERPINH1_6_S1415 | | | | | | | zc3p; rA; rC; rA; rA; rG; rA; rU; rG; rC; rG; rA; rG; rA; rC; rG2p; rA2p; rG2p; rU2p; rA2p | mU; rA; mC; mU; mC; rG; mU; mC; mU; rC; rG; mC; rA; mU; mC; mU; mU; rG; rU; zc3p; zc3p$ |
| SERPINH1_6_S1416 | | | | | | | zc3p; rA; rC; rA; rA; rG; rA; rU; rG; rC; rG; rA; rG; rA; rC; rG2p; rA2p; rG2p; rU2p; rA2p | mU; rA; mC; mU; mC; rG; mU; mC; mU; rC; rG; mC; rA; rU; mC; mU; mU; rG; rU; zc3p; zc3p$ |
| SERPINH1_6_S1417 | | | | | | | zc3p; rA; rC; rA; rA; rG; rA; rU; rG; rC; rG; rA; rG; rA; rC; rG2p; rA2p; rG2p; rU2p; rA2p | mU; rA; mC; rU; mC; rG; mU; mC; rU; mC; rG; mC; mA; rU; mC; rU; mU; rG; rU; zc3p; zc3p$ |
| SERPINH1_6_S1418 | | | | | | | zc3p; rA; rC; rA; rA; rG; rA; rU; rG; rC; rG; rA; rG; rA; rC; rG2p; rA2p; rG2p; rU2p; rA2p | mU; rA; mC; rU; mC; rG; LdT; rC; mU; rC; rG; mC; mA; rU; mC; rU; mU; rG; rU; zc3p; zc3p$ |
| SERPINH1_6_S1419 | | | | | | | zc3p; rA; rC; rA; rA; rG; rA; rU; rG; rC; rG; rA; rG; rA; rC; rG2p; rA2p; rG2p; rU2p; rA2p | mU; rA; mC; rU; mC; rG; rU2p; rC; mU; rC; rG; mC; mA; rU; mC; rU; mU; rG; rU; zc3p; zc3p$ |
| SERPINH1_6_S1420 | | | | | | | zidB; rA; rC; rA; rA; rG; rA; rU; rG; rC; rG; rA; rG; rA; rC; rG2p; rA2p; rG2p; rU2p; rA2p | mU; rA; mC; mU; mC; rG; mU; mC; mU; rC; rG; mC; rA; mU; mC; mU; mU; rG; rU; zc3p; zc3p$ |
| SERPINH1_6_S1421 | | | | | | | zidB; rA; rC; rA; rA; rG; rA; rU; rG; rC; rG; rA; rG; rA; rC; rG2p; rA2p; rG2p; rU2p; rA2p | mU; rA; mC; mU; mC; rG; mU; mC; mU; rC; rG; mC; rA; mU; mC; mU; mU; rG; rU; zc3p; zc3p$ |
| SERPINH1_6_S1422 | | | | | | | zidB; rA; rC; rA; rA; rG; rA; rU; rG; rC; rG; rA; rG; rA; rC; rG2p; rA2p; rG2p; rU2p; rA2p | mU; rA; mC; mU; mC; rG; mU; mC; mU; rC; rG; mC; rA; rU; mC; mU; mU; rG; rU; zc3p; zc3p$ |
| SERPINH1_6_S1423 | | | | | | | zidB; rA; rC; rA; rA; rG; rA; rU; rG; rC; rG; rA; rG; rA; rC; rG2p; rA2p; rG2p; rU2p; rA2p | mU; rA; mC; rU; mC; rG; mU; mC; rU; mC; rG; mC; mA; rU; mC; rU; mU; rG; rU; zc3p; zc3p$ |
| SERPINH1_6_S1424 | | | | | | | zidB; rA; rC; rA; rA; rG; rA; rU; rG; rC; rG; rA; rG; rA; rC; rG2p; rA2p; rG2p; rU2p; rA2p | mU; rA; mC; rU; mC; rG; LdT; rC; mU; rC; rG; mC; mA; rU; mC; rU; mU; rG; rU; zc3p; zc3p$ |
| SERPINH1_6_S1425 | | | | | | | zidB; rA; rC; rA; rA; rG; rA; rU; rG; rC; rG; rA; rG; rA; rC; rG2p; rA2p; rG2p; rU2p; rA2p | mU; rA; mC; rU; mC; rG; rU2p; rC; mU; rC; rG; mC; mA; rU; mC; rU; mU; rG; rU; zc3p; zc3p$ |
| SERPINH1_6_S1426 | | | | | | | zidB; rA; rC; rA; rA; rG; rA; rU; rG; rC; rG; rA; rG; rA; rC; rG2p; rA2p; rG2p; rU2p; rA2p; zc3p | mU; rA; mC; mU; mC; rG; mU; mC; mU; rC; rG; mC; rA; mU; mC; mU; mU; rG; rU; zc3p; zc3p$ |
| SERPINH1_6_S1427 | | | | | | | zidB; rA; rC; rA; rA; rG; rA; rU; rG; rC; rG; rA; rG; rA; rC; rG2p; rA2p; rG2p; rU2p; rA2p; zc3p$ | mU; rA; mC; mU; mC; rG; mU; mC; mU; rC; rG; mC; rA; mU; mC; mU; mU; rG; rU; zc3p; zc3p$ |
| SERPINH1_6_S1428 | | | | | | | zidB; rA; rC; rA; rA; rG; rA; rU; rG; rC; rG; rA; rG; rA; rC; rG2p; rA2p; rG2p; rU2p; rA2p; zc3p$ | mU; rA; mC; mU; mC; rG; mU; mC; mU; rC; rG; mC; rA; rU; mC; mU; mU; rG; rU; zc3p; zc3p$ |
| SERPINH1_6_S1429 | | | | | | | zidB; rA; rC; rA; rA; rG; rA; rU; rG; rC; rG; rA; rG; rA; rC; rG2p; rA2p; rG2p; rU2p; rA2p; zc3p$ | mU; rA; mC; rU; mC; rG; mU; mC; rU; mC; rG; mC; mA; rU; mC; rU; mU; rG; rU; zc3p; zc3p$ |
| SERPINH1_6_S1430 | | | | | | | zidB; rA; rC; rA; rA; rG; rA; rU; rG; rC; rG; rA; rG; rA; rC; rG2p; rA2p; rG2p; rU2p; rA2p; zc3p$ | mU; rA; mC; rU; mC; rG; LdT; rC; mU; rC; rG; mC; mA; rU; mC; rU; mU; rG; rU; zc3p; zc3p$ |
| SERPINH1_6_S1431 | | | | | | | zidB; rA; rC; rA; rA; rG; rA; rU; rG; rC; rG; rA; rG; rA; rC; rG2p; rA2p; rG2p; rU2p; rA2p; zc3p$ | mU; rA; mC; rU; mC; rG; rU2p; rC; mU; rC; rG; mC; mA; rU; mC; rU; mU; rG; rU; zc3p; zc3p$ |
| SERPINH1_6_S1432 | 0 | 6 | 19 | 15 | | | zidB; rA; mC; rA; rA; rG; rA; mU; rG; rC; rG; rA; rG; rA; mC; rG; rA; rG; LdT; rA$ | mU; rA; mC; rU; mC; rG; mU; rC; mU; rC; rG; mG; rC; mA; rU; mC; rU; mU; rG; mU; zc3p; zc3p$ |
| SERPINH1_6_S1435 | 6 | 37 | 46 | | | | zidB; rA; mC; rA; rA; rG; rA; mU; rG; rC; rG; rA; rG; rA; mC; rG; rA; rG; LdT; rA$ | mU; rA; mC; mU; mC; rG; mU; mC; mU; rC; rG; mC; rA; rU; mC; mU; mU; rG; rU; zc3p; zc3p$ |
| SERPINH1_6_S1436 | 3 | 10 | 17 | 5 | | | zidB; rA; mC; rA; rA; rG; rA; mU; rG; rC; rG; rA; rG; rA; mC; rG; rA; rG; LdT; rA$ | mU; rA; mC; rU; mC; rG; mU; mC; rU; mC; rG; mC; mA; rU; mC; rU; mU; rG; rU; zc3p; zc3p$ |
| SERPINH1_6_S1437 | | | | | | | zidB; rA; mC; rA; rA; rG; rA; mU; rG; rC; rG; rA; rG; rA; mC; rG; rA; rG; LdT; rA$ | mU; rA; mC; rU; mC; rG; LdT; rC; mU; rC; rG; mC; mA; rU; mC; rU; mU; rG; rU; zc3p; zc3p$ |
| SERPINH1_6_S1438 | 3 | 15 | 17 | | | | zidB; rA; mC; rA; rA; rG; rA; mU; rG; rC; rG; rA; rG; rA; mC; rG; rA; rG; LdT; rA$ | mU; rA; mC; rU; mC; rG; rU2p; rC; mU; rC; rG; mC; mA; rU; mC; rU; mU; rG; rU; zc3p; zc3p$ |
| SERPINH1_6_S1439 | 24 | 12 | 23 | 11 | | | zidB; rA; mC; rA; rA; rG; rA; mU; rG; rC; rG; rA; rG; rA; mC; rG; rA; rG; mU; rA; zc3p$ | mU; rA; mC; mU; mC; rG; mU; mC; rU; mC; rG; mG; rC; mA; rU; mC; rU; mU; rG; mU; zc3p; zc3p$ |
| SERPINH1_6_S1442 | 24 | 29 | | | | | zidB; rA; mC; rA; rA; rG; rA; mU; rG; rC; rG; rA; rG; rA; mC; rG; rA; rG; mU; rA; zc3p$ | mU; rA; mC; mU; mC; rG; mU; mC; mU; rC; rG; mC; rA; rU; mC; mU; mU; rG; rU; zc3p; zc3p$ |

TABLE 6-continued

| 1. Name | Stability in plasma (h) | % residual 5 nM 001 | % residual 5 nM 002 | % residual 25 nM 003 | % residual 25 nM 004 | 006 | Sense strand 5->3 code | AntiSense strand 5->3 code |
|---|---|---|---|---|---|---|---|---|
| SERPINH1_6_S1443 | 24 | 9 | 22 | 7 | | | zidB; rA; mC; rA; rA; rG; rA; mU; rG; rC; rG; rA; rG; rA; mC; rG; rA; rG; mU; rA; zc3p$ | mU; rA; mC; rU; mC; rG; mU; mC; mC; rG; mC; mA; rU; mC; rU; mU; rG; rU; zc3p; zc3p$ |
| SERPINH1_6_S1444 | | | | | | | zidB; rA; mC; rA; rA; rG; rA; mU; rG; rC; rG; rA; rG; rA; mC; rG; rA; rG; mU; rA; zc3p$ | mU; rA; mC; rU; mC; rG; LdT; rC; mU; rC; rG; mC; mA; rU; mC; rU; mU; rG; rU; zc3p; zc3p$ |
| SERPINH1_6_S1445 | 24 | | 19 | 18 | | | zidB; rA; mC; rA; rA; rG; rA; mU; rG; rC; rG; rA; rG; rA; mC; rG; rA; rG; mU; rA; zc3p$ | mU; rA; mC; rU; mC; rG; rU2p; rC; mU; rC; rG; mC; mA; rU; mC; rU; mU; rG; rU; zc3p; zc3p$ |
| SERPINH1_6_S1739 | 24 | | | | | 11 | zidB; rA; mC; rA; rA; rG; rA; rU; rG; rC; rG; rA; rG; rA; mC; rG; rA; rG; mU; rA; zc3p$ | mU; rA; mC; rU; mC; rG; rU2p; rC; mU; rC; mG; rC; mA; rU; mC; rU; mU; rG; rU; zc3p; zc3p$ |
| SERPINH1_6_S1741 | 24 | | | | | 12 | zidB; rA; mC; rA; rA; rG; rA; rU; rG; rC; rG; rA; rG; rA; mC; rG; rA; rG; mU; rA; zc3p$ | mU; rA; mC; rU; mC; rG; rU2p; rC; mU; rC; rG; mC; mA; rU; rC; rU; mU; rG; rU; zc3p; zc3p$ |
| SERPINH1_6_S1744 | 0 | | | | | | zidB; rA; rC; rA; rA; rG; rA; rU; rG; rC; rG; rA; rG; rA; mC; rG; rA; rG; mU; rA; zc3p$ | mU; rA; mC; rU; mC; rG; rU2p; rC; mU; rC; rG; mC; mA; rU; mC; rU; mU; rG; rU; zc3p; zc3p$ |
| SERPINH1_6_S1746 | 0 | | | | | | zidB; rA; mC; rA; rA; rG; rA; rU; rG; rC; rG; rA; rG; rA; mC; rG; rA; rG; mU; rA; zc3p$ | mU; rA; mC; rU; mC; rG; rU2p; rC; mU; rC; mG; rC; mA; rU; mC; rU; mU; rG; mU; zc3p; zc3p$ |
| SERPINH1_6_S1785 | | | | | | | zidB; rA; mC; rA; rA; rG; rA; rU; rG; rC; rG; rA; rG; rA; mC; rG; rA; rG; mU; rA; zc3p$ | dU; rA; mC; rU; mC; rG; rU2p; rC; mU; rC; mG; mC; mA; rU; rC; rU; mU; rG; rU; zc3p; zc3p$ |
| SERPINH1_11_S1356 | | | | | | | zidB; rC; rG; rG; rA; rC; rA; rG; rG; rC; rC; rU; rC; rU; rA; rC2p; rA2p; rA2p; rC2p; rA2p | mU; rG; mU; rU; mG; rU; mA; rG; mA; rG; mG; rC; mC; rU; mG; rU; mC; rC; mG; zc3p; zc3p$ |
| SERPINH1_11_S1363 | | | | | | | zc3p; rC; rG; rG; rA; rC; rA; rG; rG; rC; rC; rU; rC; rU; rA; rC2p; rA2p; rA2p; rC2p; rA2p | mU; rG; mU; rU; mG; rU; mA; rG; mA; rG; mG; rC; mC; rU; mG; rU; mC; rC; mG; zc3p; zc3p$ |
| SERPINH1_11_S1370 | | | | | | | zidB; rC; rG; rG; rA; rC; rA; rG; rG; rC; rC; rU; rC; rU; rA; rC2p; rA2p; rA2p; rC2p; rA2p; zc3p$ | mU; rG; mU; rU; mG; rU; mA; rG; mA; rG; mG; rC; mC; rU; mG; rU; mC; rC; mG; zc3p; zc3p$ |
| SERPINH1_11_S1446 | | | | | | | zc3p; rC; rG; rG; rA; rC; rA; rG; rG; rC; rC; rU; rC; rU; rA; rC2p; rA2p; rA2p; rC2p; rA2p | mU; rG; mU; mU; rG; mU; rA; rG; rA; rG; rG; mC; mC; mU; rG; mU; mC; mC; rG; zc3p; zc3p$ |
| SERPINH1_11_S1449 | | | | | | | zc3p; rC; rG; rG; rA; rC; rA; rG; rG; rC; rC; rU; rC; rU; rA; rC2p; rA2p; rA2p; rC2p; rA2p | mU; rG; mU; mU; rG; rU2p; rA; rG; rA; rG; rG; mC; rC; mU; rG; rU; mC; mC; rG; zc3p; zc3p$ |
| SERPINH1_11_S1450 | | | | | | | zc3p; rC; rG; rG; rA; rC; rA; rG; rG; rC; rC; rU; rC; rU; rA; rC2p; rA2p; rA2p; rC2p; rA2p | mU; rG; mU; mU; mU; rG; LdT; rA; rG; rA; rG; rG; mC; rC; mU; rG; rU; mC; mC; rG; zc3p; zc3p$ |
| SERPINH1_11_S1451 | | | | | | | zidB; rC; rG; rG; rA; rC; rA; rG; rG; rC; rC; rU; rC; rU; rA; rC2p; rA2p; rA2p; rC2p; rA2p | mU; rG; mU; mU; rG; mU; rA; rG; rA; rG; rG; mC; mC; mU; rG; mU; mC; mC; rG; zc3p; zc3p$ |
| SERPINH1_11_S1454 | | | | | | | zidB; rC; rG; rG; rA; rC; rA; rG; rG; rC; rC; rU; rC; rU; rA; rC2p; rA2p; rA2p; rC2p; rA2p | mU; rG; mU; mU; mU; rG; rU2p; rA; rG; rA; rG; rG; mC; rC; mU; rG; rU; mC; mC; rG; zc3p; zc3p$ |
| SERPINH1_11_S1455 | | | | | | | zidB; rC; rG; rG; rA; rC; rA; rG; rG; rC; rC; rU; rC; rU; rA; rC2p; rA2p; rA2p; rC2p; rA2p | mU; rG; mU; mU; rG; LdT; rA; rG; rA; rG; rG; mC; rC; mU; rG; rU; mC; mC; rG; zc3p; zc3p$ |
| SERPINH1_11_S1456 | | | | | | | zidB; rC; rG; rG; rA; rC; rA; rG; rG; rC; rC; rU; rC; rU; rA; rC2p; rA2p; rA2p; rC2p; rA2p; zc3p$ | mU; rG; mU; mU; rG; mU; rA; rG; rA; rG; rG; mC; mC; mU; rG; mU; mC; mC; rG; zc3p; zc3p$ |
| SERPINH1_11_S1457 | | | | | | | zidB; rC; rG; rG; rA; rC; rA; rG; rG; rC; rC; rU; rC; rU; rA; rC2p; rA2p; rA2p; rC2p; rA2p; zc3p$ | mU; rG; mU; mU; rG; mU; rA; rG; rA; rG; rG; rC; mC; mU; rG; mU; mC; mC; rG; zc3p; zc3p$ |
| SERPINH1_11_S1459 | | | | | | | zidB; rC; rG; rG; rA; rC; rA; rG; rG; rC; rC; rU; rC; rU; rA; rC2p; rA2p; rA2p; rC2p; rA2p; zc3p$ | mU; rG; mU; mU; rG; rU2p; rA; rG; rA; rG; rG; mC; rC; mU; rG; rU; mC; mC; rG; zc3p; zc3p$ |
| SERPINH1_11_S1460 | | | | | | | zidB; rC; rG; rG; rA; rC; rA; rG; rG; rC; rC; rU; rC; rU; rA; rC2p; rA2p; rA2p; rC2p; rA2p; zc3p$ | mU; rG; mU; mU; rG; LdT; rA; rG; rA; rG; rG; mC; rC; mU; rG; rU; mC; mC; rG; zc3p; zc3p$ |
| SERPINH1_11_S1461 | | | | | | | zidB; mC; rG; rG; rA; mC; rA; rG; rG; rC; mC; rU; rC; mU; rA; mC; rA; rA; LdC; rA$ | mU; rG; mU; rU; mG; rU; mA; rG; mA; rG; mG; rC; mC; rU; mG; rU; mC; rC; mG; zc3p; zc3p$ |
| SERPINH1_11_S1462 | | | | | | | zidB; mC; rG; rG; rA; mC; rA; rG; rG; rC; mC; rU; rC; mU; rA; mC; rA; rA; LdC; rA$ | mU; rG; mU; mU; rG; mU; rA; rG; rA; rG; rG; mC; mC; mU; rG; mU; mC; mC; rG; zc3p; zc3p$ |
| SERPINH1_11_S1464 | | | 45 | 43 | | | zidB; mC; rG; rG; rA; mC; rA; rG; rG; rC; mC; rU; rC; mU; rA; mC; rA; rA; LdC; rA$ | mU; rG; mU; mU; rG; mU; rA; rG; rA; rG; rG; mC; rC; mU; rG; rU; mC; mC; rG; zc3p; zc3p$ |

TABLE 6-continued

| 1. Name | Stability in plasma (h) | % residual 5 nM 001 | 002 | % residual 25 nM 003 | 004 | 006 | Sense strand 5->3 code | AntiSense strand 5->3 code |
|---|---|---|---|---|---|---|---|---|
| SERPINH1_11_S1467 | | | | | | | zidB; mC; rG; rG; rA; mC; rA; rG; rG; rC; rC; rU; rC; mU; rA; mC; rA; rA; mC; rA; zc3p$ | mU; rG; mU; rU; mG; rU; mA; rG; mA; rG; mG; rC; mC; rU; mG; rU; mC; rC; mG; zc3p; zc3p$ |
| SERPINH1_11_S1468 | | | | | | | zidB; mC; rG; rG; rA; mC; rA; rG; rG; rC; rC; rU; rC; mU; rA; mC; rA; rA; mC; rA; zc3p$ | mU; rG; mU; mU; rG; mU; rA; rG; rA; rG; rG; mC; mC; mU; rG; mU; mC; mC; rG; zc3p; zc3p$ |
| SERPINH1_11_S1469 | | | | | | | zidB; mC; rG; rG; rA; mC; rA; rG; rG; rC; rC; rU; rC; mU; rA; mC; rA; rA; mC; rA; zc3p$ | mU; rG; mU; mU; rG; mU; rA; rG; rA; rG; rG; rC; mC; mU; rG; mU; mC; mC; rG; zc3p; zc3p$ |
| SERPINH1_11_S1470 | | | | | | | zidB; mC; rG; rG; rA; mC; rA; rG; rG; rC; rC; rU; rC; mU; rA; mC; rA; rA; mC; rA; zc3p$ | mU; rG; mU; mU; rG; mU; rA; rG; rA; rG; rG; mC; rC; mU; rG; rU; mC; mC; rG; zc3p; zc3p$ |
| SERPINH1_11_S1471 | | | | | | | zidB; mC; rG; rG; rA; mC; rA; rG; rG; rC; rC; rU; rC; mU; rA; mC; rA; rA; mC; rA; zc3p$ | mU; rG; mU; mU; rG; rU2p; rA; rG; rA; rG; rG; mC; rC; mU; rG; rU; mC; mC; rG; zc3p; zc3p$ |
| SERPINH1_11_S1472 | | | | | | | zidB; mC; rG; rG; rA; mC; rA; rG; rG; rC; rC; rU; rC; mU; rA; mC; rA; rA; mC; rA; zc3p$ | mU; rG; mU; mU; rG; LdT; rA; rG; rA; rG; rG; mC; rC; mU; rG; rU; mC; mC; rG; zc3p; zc3p$ |
| SERPINH1_12_S1391 | | | | | | | zidB; rA; rC; mU; rC; mG; rU; rG; rC; rG; rA; rG; rA; rC; rG2p; rA2p; rG2p; rU2p; rU2p | rA; mA; rC; rU; rC; mG; rU; mC; rU; rC; mG; rC; mA; rU; mC; rU; mU; rG; mU; zc3p; zc3p$ |
| SERPINH1_12_S1780 | | | | | | | zidB; rA; mC; rA; mA; rG; rA; rU; rG; rC; rG; rA; rG; rA; mC; rG; rA; rG; mU; rU; zc3p$ | rA; rA; mC; rU; mC; rG; rU2p; rC; rU; rC; mG; mC; mA; rU; rC; rU; mU; rG; rU; zc3p; zc3p$ |
| SERPINH1_30_S1391 | | | | | | | zidB; rC; rG; rG; rA; rC; rA; rG; rG; rC; rC; rU; rC; rU; rA; rC2p; rA2p; rA2p; rC2p; rU2p | rA; mG; rU; mU; rG; mU; rA; mG; rA; rG; mG; rC; mC; rU; mG; rU; mC; rC; mG; zc3p; zc3p$ |
| SERPINH1_45_S1354 | | 174 | 40 | | | | rA; rC; rU; rC; rC; rA; rG; rA; rU; rC; rA; rA; rC; rU; rU; rC; rC; yrU; zdT; zdT$ | yrA; rG; rG; rA; rA; rG; rU; rU; rG; rA; rU; rC; rU; rU; rG; rG; rA; rG; rU; zdT; zdT$ |
| SERPINH1_45_S1500 | 16 | 96 | 54 | | | | zidB; rA; rC; rU; rC; rC; rA; rA; rG; rA; rU; rC; rA; rA; rC; rU2p; rU2p; rC2p; rC2p; yrU2p | ymA; rG; rG; rA; rA; rG; mU; mU; rG; rA; mU; mC; mU; mU; rG; rG; rA; rG; rU; zc3p; zc3p$ |
| SERPINH1_45_S1501 | | | | | | | zidB; rA; rC; rU; rC; rC; rA; rA; rG; rA; rU; rC; rA; rA; rC; rU2p; rU2p; rC2p; rC2p; yrU2p | ymA; rG; mG; rA; mA; rG; mU; mU; rG; rA; mU; rC; mU; mU; rG; mG; rA; mG; rU; zc3p; zc3p$ |
| SERPINH1_45_S1502 | | | | | | | zidB; rA; rC; rU; rC; rC; rA; rA; rG; rA; rU; rC; rA; rA; rC; rU2p; rU2p; rC2p; rC2p; yrU2p | ymA; rG; mG; rA; mA; rG; mU; mU; rG; rA; rU; mC; mU; mU; rG; mG; rA; mG; rU; zc3p; zc3p$ |
| SERPINH1_45_S1505 | 16 | 22 | 17 | | | | zidB; rA; rC; rU; rC; rC; rA; rA; rG; rA; rU; rC; rA; rA; rC; rU2p; rU2p; rC2p; rC2p; yrU2p | yrA; mG; rG; mA; rA; mG; rU; mU; rG; rA; mU; rC; mU; rU; mG; rG; mA; rG; mU; zc3p; zc3p$ |
| SERPINH1_45_S1506 | | | | | | | zc3p; rA; rC; rU; rC; rC; rA; rA; rG; rA; rU; rC; rA; rA; rC; rU2p; rU2p; rC2p; rC2p; yrU2p | ymA; rG; rG; rA; rA; rG; mU; mU; rG; rA; mU; mC; mU; mU; rG; rG; rA; rG; rU; zc3p; zc3p$ |
| SERPINH1_45_S1507 | | | | | | | zc3p; rA; rC; rU; rC; rC; rA; rA; rG; rA; rU; rC; rA; rA; rC; rU2p; rU2p; rC2p; rC2p; yrU2p | ymA; rG; mG; rA; mA; rG; mU; mU; rG; rA; mU; rC; mU; mU; rG; mG; rA; mG; rU; zc3p; zc3p$ |
| SERPINH1_45_S1508 | | | | | | | zc3p; rA; rC; rU; rC; rC; rA; rA; rG; rA; rU; rC; rA; rA; rC; rU2p; rU2p; rC2p; rC2p; yrU2p | ymA; rG; mG; rA; mA; rG; mU; mU; rG; rA; rU; mC; mU; mU; rG; mG; rA; mG; rU; zc3p; zc3p$ |
| SERPINH1_45_S1509 | 16 | | | | | | zc3p; rA; rC; rU; rC; rC; rA; rA; rG; rA; rU; rC; rA; rA; rC; rU2p; rU2p; rC2p; rC2p; yrU2p | ymA; rG; rG; rA; rA; rG; rU2p; mU; rG; rA; mU; rC; mU; mU; rG; mG; rA; mG; rU; zc3p; zc3p$ |
| SERPINH1_45_S1510 | | | | | | | zc3p; rA; rC; rU; rC; rC; rA; rA; rG; rA; rU; rC; rA; rA; rC; rU2p; rU2p; rC2p; rC2p; yrU2p | ymA; rG; rG; rA; rA; rG; LdT; mU; rG; rA; mU; rC; mU; mU; rG; mG; rA; mG; rU; zc3p; zc3p$ |
| SERPINH1_45_S1511 | 8 | | 27 | | | | zc3p; rA; rC; rU; rC; rC; rA; rA; rG; rA; rU; rC; rA; rA; rC; rU2p; rU2p; rC2p; rC2p; yrU2p | yrA; mG; rG; mA; rA; mG; rU; mU; rG; rA; mU; rC; mU; rU; mG; rG; mA; rG; mU; zc3p; zc3p$ |
| SERPINH1_45_S1512 | | | | | | | zidB; rA; rC; rU; rC; rC; rA; rA; rG; rA; rU; rC; rA; rA; rC; rU2p; rU2p; rC2p; rC2p; yrU2p; zc3p$ | ymA; rG; rG; rA; rA; rG; mU; mU; rG; rA; mU; mC; mU; mU; rG; rG; rA; rG; rU; zc3p; zc3p$ |
| SERPINH1_45_S1513 | | | | | | | zidB; rA; rC; rU; rC; rC; rA; rA; rG; rA; rU; rC; rA; rA; rC; rU2p; rU2p; rC2p; rC2p; yrU2p; zc3p$ | ymA; rG; mG; rA; mA; rG; mU; mU; rG; rA; mU; rC; mU; mU; rG; mG; rA; mG; rU; zc3p; zc3p$ |
| SERPINH1_45_S1514 | | | | | | | zidB; rA; rC; rU; rC; rC; rA; rA; rG; rA; rU; rC; rA; rA; rC; rU2p; rU2p; rC2p; rC2p; yrU2p; zc3p$ | ymA; rG; mG; rA; mA; rG; mU; mU; rG; rA; rU; mC; mU; mU; rG; mG; rA; mG; rU; zc3p; zc3p$ |
| SERPINH1_45_S1515 | | | | | | | zidB; rA; rC; rU; rC; rC; rA; rA; rG; rA; rU; rC; rA; rA; rC; rU2p; rU2p; rC2p; rC2p; yrU2p; zc3p$ | ymA; rG; rG; rA; rA; rG; rU2p; mU; rG; rA; mU; rC; mU; mU; rG; mG; rA; mG; rU; zc3p; zc3p$ |

TABLE 6-continued

| 1. Name | Stability in plasma (h) | % residual 5 nM 001 | % residual 5 nM 002 | % residual 25 nM 003 | % residual 25 nM 004 | 006 | Sense strand 5->3 code | AntiSense strand 5->3 code |
|---|---|---|---|---|---|---|---|---|
| SERPINH1_45_S1516 | | | | | | | zidB; rA; rC; rU; rC; rC; rA; rA; rG; rA; rU; rC; rA; rA; rC; rU2p; rU2p; rC2p; rC2p; yrU2p; zc3p$ | ymA; rG; rG; rA; rA; rG; LdT; mU; rG; rA; mU; rC; mU; mU; rG; mG; rA; mG; rU; zc3p; zc3p$ |
| SERPINH1_45_S1517 | 24 | 22 | 31 | 7 | 11 | 14 | zidB; rA; rC; rU; rC; rC; rA; rA; rG; rA; rU; rC; rA; rA; rC; rU2p; rU2p; rC2p; rC2p; yrU2p; zc3p$ | yrA; mG; rG; mA; rA; mG; rU; mU; rG; rA; mU; rC; mU; rU; mG; rG; mA; rG; mU; zc3p; zc3p$ |
| SERPINH1_45_S1518 | 8 | 90 | 47 | | | | zidB; rA; rC; rU; mC; mC; rA; rA; rG; rA; rU; mC; rA; rA; mC; mU; rU; rC; LdC; yrU$ | ymA; rG; rG; rA; rA; rG; mU; mU; rG; rA; mU; mC; mU; mU; rG; rG; rA; rG; rU; zc3p; zc3p$ |
| SERPINH1_45_S1523 | 3 | 17 | 30 | | 16 | | zidB; rA; rC; rU; mC; mC; rA; rA; rG; rA; rU; mC; rA; rA; mC; mU; rU; rC; LdC; yrU$ | yrA; mG; rG; mA; rA; mG; rU; mU; rG; rA; mU; rC; mU; rU; mG; rG; mA; rG; mU; zc3p; zc3p$ |
| SERPINH1_45_S1524 | | | | | | | zidB; rA; rC; rU; rC; mC; rA; rA; rG; rA; rU; mC; rA; rA; rC; mU; rU; mC; mC; yrU; zc3p$ | ymA; rG; rG; rA; rA; rG; mU; mU; rG; rA; mU; mC; mU; mU; rG; rG; rA; rG; rU; zc3p; zc3p$ |
| SERPINH1_45_S1525 | | | | | | | zidB; rA; rC; rU; rC; mC; rA; rA; rG; rA; rU; mC; rA; rA; rC; mU; rU; mC; mC; yrU; zc3p$ | ymA; rG; mG; rA; mA; rG; mU; mU; rG; rA; mU; rC; mU; mU; rG; mG; rA; mG; rU; zc3p; zc3p$ |
| SERPINH1_45_S1529 | 24 | 17 | 33 | | | | zidB; rA; rC; rU; rC; mC; rA; rA; rG; rA; rU; mC; rA; rA; rC; mU; rU; mC; mC; yrU; zc3p$ | yrA; mG; rG; mA; rA; mG; rU; mU; rG; rA; mU; rC; mU; rU; mG; rG; mA; rG; mU; zc3p; zc3p$ |
| SERPINH1_45_S1684 | 24 | | | | 14 | | zidB; rA; rC; rU; rC; rC; rA; rA; rG; rA; rU; rC; rA; rA; rC; rU2p; rU2p; rC2p; rC2p; yrU2p; zc3p$ | yrA; mG; rG; mA; rA; mG; rU2p; mU; rG; rA; mU; rC; mU; rU; mG; rG; mA; rG; mU; zc3p; zc3p$ |
| SERPINH1_45_S1685 | 8 | | | | 15 | | zidB; rA; rC; rU; mC; mC; rA; rA; rG; rA; rU; mC; rA; rA; mC; mU; rU; rC; LdC; yrU$ | yrA; mG; rG; mA; rA; mG; rU2p; mU; rG; rA; mU; rC; mU; rU; mG; rG; mA; rG; mU; zc3p; zc3p$ |
| SERPINH1_45_S1781 | | | | | | | zidB; rA; rC; rU; rC; rC; rA; rA; rG; rA; rU; rC; rA; rA; rC; rU2p; rU2p; rC2p; rC2p; yrU2p; zc3p$ | rU; rG; rG; mA; rA; mG; rU2p; mU; rG; rA; mU; rC; mU; rU; mG; rG; mA; rG; mU; zc3p; zc3p$ |
| SERPINH1_45_S1786 | | | | | | | zidB; rA; rC; rU; rC; rC; rA; rA; rG; rA; rU; rC; rA; rA; rC; rU2p; rU2p; rC2p; rC2p; rA2p; zc3p$ | dU; rG; rG; mA; rA; mG; rU2p; mU; rG; rA; mU; rC; mU; rU; mG; rG; mA; rG; mU; zc3p; zc3p$ |
| SERPINH1_51_S1356 | | | | | | | zidB; rU; rC; rC; rU; rG; rA; rG; rA; rC; rA; rC; rA; rU; rG; rG2p; rG2p; rU2p; rG2p; rA2p | mU; rC; mA; rC; mC; rC; mA; rU; mG; rU; mG; rU; mC; rU; mC; rA; mG; mA; zc3p; zc3p$ |
| SERPINH1_51_S1363 | | | | | | | zc3p; rU; rC; rC; rU; rG; rA; rG; rA; rC; rA; rC; rA; rU; rG; rG2p; rG2p; rU2p; rG2p; rA2p; | mU; rC; mA; rC; mC; rC; mA; rU; mG; rU; mG; rU; mC; rU; mC; rA; mG; rG; mA; zc3p; zc3p$ |
| SERPINH1_51_S1370 | | | | | | | zidB; rU; rC; rC; rU; rG; rA; rG; rA; rC; rA; rC; rA; rU; rG; rG2p; rU2p; rG2p; rA2p; zc3p$ | mU; rC; mA; rC; mC; rC; mA; rU; mG; rU; mG; rU; mC; rU; mC; rA; mG; rG; mA; zc3p; zc3p$ |
| SERPINH1_51_S1473 | | | | | | | zc3p; rU; rC; rC; rU; rG; rA; rG; rA; rC; rA; rC; rA; rU; rG; rG2p; rU2p; rG2p; rA2p; | mU; mC; rA; mC; mC; mC; rA; mU; rG; mU; rG; mU; mC; mU; mC; rA; rG; rG; rA; zc3p; zc3p$ |
| SERPINH1_51_S1474 | | | | | | | zc3p; rU; rC; rC; rU; rG; rA; rG; rA; rC; rA; rC; rA; rU; rG; rG2p; rU2p; rG2p; rA2p; | mU; rC; mA; rC; mC; rC; mA; rU; mG; rU; mG; rU; mC; rU; mC; rA; mG; rG; mA; zc3p; zc3p$ |
| SERPINH1_51_S1475 | | | | | | | zc3p; rU; rC; rC; rU; rG; rA; rG; rA; rC; rA; rC; rA; rU; rG; rG2p; rU2p; rG2p; rA2p; | mU; rC; mA; rC; mC; rC; mA; rU; mG; rU; mG; rU; mC; rU; mC; rA; mG; rG; mA; zc3p; zc3p$ |
| SERPINH1_51_S1476 | | | | | | | zc3p; rU; rC; rC; rU; rG; rA; rG; rA; rC; rA; rC; rA; rU; rG; rG2p; rU2p; rG2p; rA2p; | mU; rC; mA; rC; mC; rC; mA; rU; mG; rU; mG; rU; mC; rU; mC; rA; mG; rG; mA; zc3p; zc3p$ |
| SERPINH1_51_S1477 | | | | | | | zc3p; rU; rC; rC; rU; rG; rA; rG; rA; rC; rA; rC; rA; rU; rG; rG2p; rU2p; rG2p; rA2p; | mU; rC; mA; rC; mC; rC; mA; rU; mG; rU; mG; rU; mC; rU; mC; rA; mG; rG; mA; zc3p; zc3p$ |
| SERPINH1_51_S1478 | | | | | | | zidB; rU; rC; rC; rU; rG; rA; rG; rA; rC; rA; rC; rA; rU; rG; rG2p; rU2p; rG2p; rA2p | mU; mC; rA; mC; mC; mC; rA; mU; rG; mU; rG; mU; mC; mU; mC; rA; rG; rG; rA; zc3p; zc3p$ |
| SERPINH1_51_S1479 | | | | | | | zidB; rU; rC; rC; rU; rG; rA; rG; rA; rC; rA; rC; rA; rU; rG; rG2p; rU2p; rG2p; rA2p | mU; rC; mA; rC; mC; rC; mA; rU; mG; rU; mG; rU; mC; rU; mC; rA; mG; rG; mA; zc3p; zc3p$ |
| SERPINH1_51_S1480 | | | | | | | zidB; rU; rC; rC; rU; rG; rA; rG; rA; rC; rA; rC; rA; rU; rG; rG2p; rU2p; rG2p; rA2p | mU; rC; mA; rC; mC; rC; mA; rU; mG; rU; mG; rU; mC; rU; mC; rA; mG; rG; mA; zc3p; zc3p$ |
| SERPINH1_51_S1481 | | | | | | | zidB; rU; rC; rC; rU; rG; rA; rG; rA; rC; rA; rC; rA; rU; rG; rG2p; rU2p; rG2p; rA2p | mU; rC; mA; rC; mC; rC; mA; rU; mG; rU; mG; rU; mC; rU; mC; rA; mG; rG; mA; zc3p; zc3p$ |
| SERPINH1_51_S1482 | | | | | | | zidB; rU; rC; rC; rU; rG; rA; rG; rA; rC; rA; rC; rA; rU; rG; rG2p; rU2p; rG2p; rA2p | mU; rC; mA; rC; mC; rC; mA; rU; mG; rU; mG; rU; mC; rU; mC; rA; mG; rG; mA; zc3p; zc3p$ |

TABLE 6-continued

| 1. Name | Stability in plasma (h) | % residual 5 nM 001 | 002 | % residual 25 nM 003 | 004 | 006 | Sense strand 5->3 code | AntiSense strand 5->3 code |
|---|---|---|---|---|---|---|---|---|
| SERPINH1_51_S1483 | | | | | | | zidB; rU; rC; rC; rU; rG; rA; rG; rA; rC; rA; rC; rA; rU; rG; rG2p; rG2p; rU2p; rG2p; rA2p; zc3p$ | mU; mC; rA; mC; mC; mC; rA; mU; rG; mU; rG; mU; mC; mU; mC; rA; rG; rG; rA; zc3p; zc3p$ |
| SERPINH1_51_S1484 | | | | | | | zidB; rU; rC; rC; rU; rG; rA; rG; rA; rC; rA; rC; rA; rU; rG; rG2p; rG2p; rU2p; rG2p; rA2p; zc3p$ | mU; rC; mA; rC; mC; rC; mA; rU; mG; rU; mG; rU; mC; rU; mC; rA; mG; rG; mA; zc3p; zc3p$ |
| SERPINH1_51_S1485 | | | | | | | zidB; rU; rC; mC; rU; rG; rA; rG; rA; rC; rA; rC; rA; rU; rG; rG2p; rG2p; rU2p; rG2p; rA2p; zc3p$ | mU; rC; mA; rC; mC; rC; mA; rU; mG; rU; mG; rU; mC; rU; mC; rA; mG; rG; mA; zc3p; zc3p$ |
| SERPINH1_51_S1486 | | | | | | | zidB; rU; rC; rC; rU; rG; rA; rG; rA; rC; rA; rC; rA; rU; rG; rG2p; rG2p; rU2p; rG2p; rA2p; zc3p$ | mU; rC; rA; mC; rC; rC2p; rA; mU; rG; rU; rG; mU; mC; rU; mC; rA; rG; rG; rA; zc3p; zc3p$ |
| SERPINH1_51_S1487 | | | | | | | zidB; rU; rC; rC; rU; rG; rA; rG; rA; rC; rA; rC; rA; rU; rG; rG2p; rG2p; rU2p; rG2p; rA2p; zc3p$ | mU; rC; rA; mC; rC; LdC; rA; mU; rG; rU; rG; mU; mC; rU; mC; rA; rG; rG; rA; zc3p; zc3p$ |
| SERPINH1_51_S1488 | | | | | | | zidB; rU; mC; rC; mU; rG; rA; rG; rA; rC; rA; mC; rA; mU; rG; rG; rG; rU; LdG; rA$ | mU; rC; mA; rC; mC; rC; mA; rU; mG; rU; mG; rU; mC; rU; mC; rA; mG; rG; mA; zc3p; zc3p$ |
| SERPINH1_51_S1489 | 8 | | 25 | | | | zidB; rU; mC; rC; mU; rG; rA; rG; rA; rC; rA; mC; rA; mU; rG; rG; rG; rU; LdG; rA$ | mU; mC; rA; mC; mC; mC; rA; mU; rG; mU; rG; mU; mC; mU; mC; rA; rG; rG; rA; zc3p; zc3p$ |
| SERPINH1_51_S1490 | | | | | | | zidB; rU; mC; rC; mU; rG; rA; rG; rA; rC; rA; mC; rA; mU; rG; rG; rG; rU; LdG; rA$ | mU; rC; rA; mC; mC; rA; mU; rG; rU; rG; mU; mC; mU; mC; rA; rG; rG; rA; zc3p; zc3p$ |
| SERPINH1_51_S1491 | | | | | | | zidB; rU; mC; rC; mU; rG; rA; rG; rA; rC; rA; mC; rA; mU; rG; rG; rG; rU; LdG; rA$ | mU; rC; rA; mC; mC; mC; rA; mU; rG; rU; rG; mU; mC; rU; mC; rA; rG; rG; rA; zc3p; zc3p$ |
| SERPINH1_51_S1492 | | | | | | | zidB; rU; mC; rC; mU; rG; rA; rG; rA; rC; rA; mC; rA; mU; rG; rG; rG; rU; LdG; rA$ | mU; rC; rA; mC; rC; rC2p; rA; mU; rG; rU; rG; mU; mC; rU; mC; rA; rG; rG; rA; zc3p; zc3p$ |
| SERPINH1_51_S1493 | | | | | | | zidB; rU; mC; rC; mU; rG; rA; rG; rA; rC; rA; mC; rA; mU; rG; rG; rG; rU; LdG; rA$ | mU; rC; rA; mC; rC; LdC; rA; mU; rG; rU; rG; mU; mC; rU; mC; rA; rG; rG; rA; zc3p; zc3p$ |
| SERPINH1_51_S1494 | | | | | | | zidB; rU; mC; rC; mU; rG; rA; rG; rA; rC; rA; mC; rA; mU; rG; rG; rG; mU; rG; rA; zc3p$ | mU; rC; mA; rC; mC; rC; mA; rU; mG; rU; mG; rU; mC; rU; mC; rA; mG; rG; mA; zc3p; zc3p$ |
| SERPINH1_51_S1495 | | | | | | | zidB; rU; mC; rC; mU; rG; rA; rG; rA; rC; rA; mC; rA; mU; rG; rG; rG; mU; rG; rA; zc3p$ | mU; mC; rA; mC; mC; mC; rA; mU; rG; mU; rG; mU; mC; mU; mC; rA; rG; rG; rA; zc3p; zc3p$ |
| SERPINH1_51_S1496 | | | | | | | zidB; rU; mC; rC; mU; rG; rA; rG; rA; rC; rA; mC; rA; mU; rG; rG; rG; mU; rG; rA; zc3p$ | mU; rC; rA; mC; mC; mC; rA; mU; rG; rU; rG; mU; mC; mU; mC; rA; rG; rG; rA; zc3p; zc3p$ |
| SERPINH1_51_S1497 | | | | | | | zidB; rU; mC; rC; mU; rG; rA; rG; rA; rC; rA; mC; rA; mU; rG; rG; rG; mU; rG; rA; zc3p$ | mU; rC; rA; mC; mC; mC; rA; mU; rG; rU; rG; mU; mC; rU; mC; rA; rG; rG; rA; zc3p; zc3p$ |
| SERPINH1_51_S1498 | 24 | 22 | | 10 | 7 | | zidB; rU; mC; rC; mU; rG; rA; rG; rA; rC; rA; mC; rA; mU; rG; rG; rG; mU; rG; rA; zc3p$ | mU; rC; rA; mC; rC; rC2p; rA; mU; rG; rU; rG; mU; mC; rU; mC; rA; rG; rG; rA; zc3p; zc3p$ |
| SERPINH1_51_S1499 | 24 | 25 | | 31 | 18 | 28 | zidB; rU; mC; rC; mU; rG; rA; rG; rA; rC; rA; mC; rA; mU; rG; rG; rG; mU; rG; rA; zc3p$ | mU; rC; rA; mC; rC; LdC; rA; mU; rG; rU; rG; mU; mC; rU; mC; rA; rG; rG; rA; zc3p; zc3p$ |
| SERPINH1_51_S1666 | | | | | | | zidB; rU; rC; rC; mU; rG; rA; rG; rA; rC2p; rA; mC; rA; mU; rG; rG; rG; mU; rG; rA; zc3p$ | mU; rC; rA; mC; rC; rC2p; rA; mU; rG; rU; rG; mU; mC; rU; mC; rA; rG; rG; rA; zc3p; zc3p$ |
| SERPINH1_51_S1667 | | | | | | | zidB; rU; rC; rC; mU; rG; rA; rG; rA; rC2p; rA; mC; rA; mU; rG; rG; rG; mU; rG; rA; zc3p$ | mU; rC; rA; mC; rC; LdC; rA; mU; rG; rU; rG; mU; mC; rU; mC; rA; rG; rG; rA; zc3p; zc3p$ |
| SERPINH1_51_S1668 | 16 | | | | | 14 | zidB; rU; rC; rC; mU; rG; rA; rG; rA; rC2p; rA; mC; rA; mU; rG; rG; rG; mU; rG; rA; zc3p$ | mU; rC; rA; mC; rC; rC2p; rA; mU; rG; rU; rG; rU; mC; rU; mC; rA; rG; rG; rA; zc3p; zc3p$ |
| SERPINH1_51_S1669 | 24 | | | | | 18 | zidB; rU; rC; rC; mU; rG; rA; rG; rA; rC2p; rA; mC; rA; mU; rG; rG; rG; mU; rG; rA; zc3p$ | mU; rC; rA; mC; rC; rC2p; rA; mU; rG; rU; mG; rU; rC; rU; mC; rA; rG; rG; rA; zc3p; zc3p$ |
| SERPINH1_51_S1670 | 16 | | | | | 13 | zidB; rU; rC; rC; mU; rG; rA; rG; rA; rC2p; rA; mC; rA; mU; rG; rG; rG; mU; rG; rA; zc3p$ | mU; rC; mA; rC; rC2p; rA; mU; rG; rU; rG; mU; mC; rU; mC; rA; rG; rG; rA; zc3p; zc3p$ |
| SERPINH1_51_S1673 | 24 | | | | | 22 | zidB; rU; rC; rC; mU; rG; rA; rG; rA; rC; rA; mC; rA; mU; rG; rG; rG; mU; rG; rA; zc3p$ | mU; rC; rA; mC; rC; rC2p; rA; mU; rG; rU; rG; rU; mC; rU; mC; rA; rG; rG; rA; zc3p; zc3p$ |
| SERPINH1_51_S1674 | 16 | | | | | | zidB; rU; rC; rC; mU; rG; rA; rG; rA; rC; rA; mC; rA; mU; rG; rG; rG; mU; rG; rA; zc3p$ | mU; rC; rA; mC; rC; rC2p; rA; mU; rG; rU; mG; rU; rC; rU; mC; rA; rG; rG; rA; zc3p; zc3p$ |

TABLE 6-continued

| 1. Name | Stability in plasma (h) | % residual 5 nM 001 | 002 | % residual 25 nM 003 | 004 | 006 | Sense strand 5->3 code | AntiSense strand 5->3 code |
|---|---|---|---|---|---|---|---|---|
| SERPINH1_51_S1675 | 16 | | | | | 35 | zidB; rU; rC; rC; mU; rG; rA; rG; rA; rC; rA; mC; rA; mU; rG; rG; rG; mU; rG; rA; zc3p$ | mU; rC; mA; rC; rC; rC2p; rA; mU; rG; rU; rG; mU; mC; rU; mC; rA; rG; rG; rA; zc3p; zc3p$ |
| SERPINH1_51_S1676 | 10 | | | | | | zidB; rU; rC; rC; mU; rG; rA; rG; rA; rC; rA; mC; rA; mU; rG; rG; rG; rU2p; rG; rA; zc3p$ | mU; rC; rA; mC; rC; rC2p; rA; mU; rG; rU; rG; mU; mC; rU; mC; rA; rG; rG; rA; zc3p; zc3p$ |
| SERPINH1_51_S1677 | 10 | | | | | | zidB; rU; rC; rC; mU; rG; rA; rG; rA; rC; rA; mC; rA; mU; rG; rG; rG; rU2p; rG; rA; zc3p$ | mU; rC; rA; mC; rC; LdC; rA; mU; rG; rU; rG; mU; mC; rU; mC; rA; rG; rG; rA; zc3p; zc3p$ |
| SERPINH1_51_S1678 | 10 | | | | | | zidB; rU; rC; rC; mU; rG; rA; rG; rA; rC; rA; mC; rA; mU; rG; rG; rG; rU2p; rG; rA; zc3p$ | mU; rC; rA; mC; rC; rC2p; rA; mU; rG; rU; rG; rU; mC; rU; mC; rA; rG; rG; rA; zc3p; zc3p$ |
| SERPINH1_51_S1679 | 10 | | | | | | zidB; rU; rC; rC; mU; rG; rA; rG; rA; rC; rA; mC; rA; mU; rG; rG; rG; rU2p; rG; rA; zc3p$ | mU; rC; rA; mC; rC; rC2p; rA; mU; rG; rU; mG; rU; rC; rU; mC; rA; rG; rG; rA; zc3p; zc3p$ |
| SERPINH1_51_S1680 | 10 | | | | | | zidB; rU; rC; rC; mU; rG; rA; rG; rA; rC; rA; mC; rA; mU; rG; rG; rG; rU2p; rG; rA; zc3p$ | mU; rC; mA; rC; rC; rC2p; rA; mU; rG; rU; rG; mU; mC; rU; mC; rA; rG; rG; rA; zc3p; zc3p$ |
| SERPINH1_51_S1682 | 8 | | | | | 16 | zidB; rU; rC; rC; mU; rG; rA; rG; rA; rC; rA; mC; rA; mU; rG; rG; rG; mU; rG; rA; zc3p$ | mU; rC; rA; mC; rC; rC2p; rA; mU; rG; rU; mG; rU; rC; rU; mC; rA; rG; rG; rA; zc3p; zc3p$ |
| SERPINH1_51_S1778 | | | | | | | zidB; rU; rC; rC; mU; rG; rA; rG; rA; rC2p; rA; mC; rA; mU; rG; rG; rG; mU; rG; yrU; zc3p$ | yrA; rC; rA; mC; rC; rC2p; rA; mU; rG; rU; mG; rU; rC; rU; mC; rA; rG; rG; rA; zc3p; zc3p$ |
| SERPINH1_51_S1779 | | | | | | | zidB; rU; mC; rC; mU; rG; rA; rG; rA; rC; rA; mC; rA; mU; rG; rG; rG; mU; rG; yrU; zc3p$ | yrA; rC; rA; mC; rC; rC2p; rA; mU; rG; rU; mG; rU; rC; rU; mC; rA; rG; rG; rA; zc3p; zc3p$ |
| SERPINH1_51_S1783 | | | | | | | zidB; rU; rC; rC; mU; rG; rA; rG; rA; rC2p; rA; mC; rA; mU; rG; rG; rG; mU; rG; rA; zc3p$ | dU; rC; rA; mC; rC; rC2p; rA; mU; rG; rU; mG; rU; rC; rU; mC; rA; rG; rG; rA; zc3p; zc3p$ |
| SERPINH1_51_S1784 | | | | | | | zidB; rU; mC; rC; mU; rG; rA; rG; rA; rC; rA; mC; rA; mU; rG; rG; rG; mU; rG; rA; zc3p$ | dU; rC; rA; mC; rC; rC2p; rA; mU; rG; rU; mG; rU; rC; rU; mC; rA; rG; rG; rA; zc3p; zc3p$ |
| SERPINH1_52_S1356 | | | | | | | zidB; rG; rA; rC; rA; rA; rG; rA; rU; rG; rC; rG; rA; rG; rA; rC2p; rG2p; rA2p; rG2p; rA2p | mU; rC; mU; rC; mG; rU; mC; rU; mC; rG; mC; rA; mU; rC; mU; rU; mG; rU; mC; zc3p; zc3p$ |
| SERPINH1_52_S1363 | | | | | | | zc3p; rG; rA; rC; rA; rA; rG; rA; rU; rG; rC; rG; rA; rG; rA; rC2p; rG2p; rA2p; rG2p; rA2p | mU; rC; mU; rC; mG; rU; mC; rU; mC; rG; mC; rA; mU; rC; mU; rU; mG; rU; mC; zc3p; zc3p$ |
| SERPINH1_52_S1370 | | | | | | | zidB; rG; rA; rC; rA; rA; rG; rA; rU; rG; rC; rG; rA; rG; rA; rC2p; rG2p; rA2p; rG2p; rA2p; zc3p$ | mU; rC; mU; rC; mG; rU; mC; rU; mC; rG; mC; rA; mU; rC; mU; rU; mG; rU; mC; zc3p; zc3p$ |
| SERPINH1_52_S1552 | | | | | | | zc3p; rG; rA; rC; rA; rA; rG; rA; rU; rG; rC; rG; rA; rG; rA; rC2p; rG2p; rA2p; rG2p; rA2p | mU; rC; mU; mC; rG; mU; mC; mU; mC; rG; mC; rA; mU; mC; mU; mU; rG; mU; rC; zc3p; zc3p$ |
| SERPINH1_52_S1553 | | | | | | | zc3p; rG; rA; rC; rA; rA; rG; rA; rU; rG; rC; rG; rA; rG; rA; rC2p; rG2p; rA2p; rG2p; rA2p; | mU; rC; mU; mC; rG; mU; mC; rG; mU; mC; rU; mC; rG; mC; rA; mU; mC; rU; mG; mU; rC; zc3p; zc3p$ |
| SERPINH1_52_S1554 | | | | | | | zc3p; rG; rA; rC; rA; rA; rG; rA; rU; rG; rC; rG; rA; rG; rA; rC2p; rG2p; rA2p; rG2p; rA2p | mU; rC; mU; mC; rG; mU; mC; rU; mC; rG; mC; rA; rU; mC; mU; mU; rG; mU; rC; zc3p; zc3p$ |
| SERPINH1_52_S1555 | | | | | | | zc3p; rG; rA; rC; rA; rA; rG; rA; rU; rG; rC; rG; rA; rG; rA; rC2p; rG2p; rA2p; rG2p; rA2p | mU; rC; mU; mC; rG; mU; mC; rU; mC; rG; mC; rA; mU; rC; mU; mU; rG; mU; rC; zc3p; zc3p$ |
| SERPINH1_52_S1556 | | | | | | | zc3p; rG; rA; rC; rA; rA; rG; rA; rU; rG; rC; rG; rA; rG; rA; rC2p; rG2p; rA2p; rG2p; rA2p | mU; rC; mU; mC; rG; rU; LdC; rU; mC; rG; mC; rA; rU; mC; mU; mU; rG; mU; rC; zc3p; zc3p$ |
| SERPINH1_52_S1557 | | | | | | | zc3p; rG; rA; rC; rA; rA; rG; rA; rU; rG; rC; rG; rA; rG; rA; rC2p; rG2p; rA2p; rG2p; rA2p | mU; rC; mU; mC; rG; rU; rC2p; rU; mC; rG; mC; rA; rU; mC; mU; mU; rG; mU; rC; zc3p; zc3p$ |
| SERPINH1_52_S1558 | | | | | | | zidB; rG; rA; rC; rA; rA; rG; rA; rU; rG; rC; rG; rA; rG; rA; rC2p; rG2p; rA2p; rG2p; rA2p | mU; rC; mU; mC; rG; mU; mC; mU; mC; rG; mC; rA; mU; mC; mU; mU; rG; mU; rC; zc3p; zc3p$ |
| SERPINH1_52_S1559 | | | | | | | zidB; rG; rA; rC; rA; rA; rG; rA; rU; rG; rC; rG; rA; rG; rA; rC2p; rG2p; rA2p; rG2p; rA2p | mU; rC; mU; mC; rG; mU; mC; rU; mC; rG; mC; rA; mU; mC; rU; mU; rG; mU; rC; zc3p; zc3p$ |
| SERPINH1_52_S1560 | | | | | | | zidB; rG; rA; rC; rA; rA; rG; rA; rU; rG; rC; rG; rA; rG; rA; rC2p; rG2p; rA2p; rG2p; rA2p | mU; rC; mU; mC; rG; mU; mC; rU; mC; rG; mC; rA; rU; mC; mU; mU; rG; mU; rC; zc3p; zc3p$ |
| SERPINH1_52_S1561 | | | | | | | zidB; rG; rA; rC; rA; rA; rG; rA; rU; rG; rC; rG; rA; rG; rA; rC2p; rG2p; rA2p; rG2p; rA2p | mU; rC; mU; mC; rG; mU; mC; rU; mC; rG; mC; rA; mU; rC; mU; mU; rG; mU; rC; zc3p; zc3p$ |

TABLE 6-continued

| 1. Name | Stability in plasma (h) | % residual 5 nM | | % residual 25 nM | | | Sense strand 5->3 code | AntiSense strand 5->3 code |
|---|---|---|---|---|---|---|---|---|
| | | 001 | 002 | 003 | 004 | 006 | | |
| SERPINH1_52_S1562 | | | | | | | zidB; rG; rA; rC; rA; rA; rG; rA; rU; rG; rC; rG; rA; rG; rA; rC2p; rG2p; rA2p; rG2p; rA2p | mU; rC; mU; mC; rG; rU; LdC; rU; mC; rG; mC; rA; rU; mC; mU; mU; rG; mU; rC; zc3p; zc3p$ |
| SERPINH1_52_S1563 | | | | | | | zidB; rG; rA; rC; rA; rA; rG; rA; rU; rG; rC; rG; rA; rG; rA; rC2p; rG2p; rA2p; rG2p; rA2p | mU; rC; mU; mC; rG; rU; rC2p; rU; mC; rG; mC; rA; rU; mC; mU; mU; rG; mU; rC; zc3p; zc3p$ |
| SERPINH1_52_S1564 | 16 | 94 | | | | | zidB; rG; rA; rC; rA; rA; rG; rA; rU; rG; rC; rG; rA; rG; rA; rC2p; rG2p; rA2p; rG2p; rA2p; zc3p$ | mU; rC; mU; mC; rG; mU; mC; mU; mC; rG; mC; rA; mU; mC; mU; mU; rG; mU; rC; zc3p; zc3p$ |
| SERPINH1_52_S1565 | | | | | | | zidB; rG; rA; rC; rA; rA; rG; rA; rU; rG; rC; rG; rA; rG; rA; rC2p; rG2p; rA2p; rG2p; rA2p; zc3p$ | mU; rC; mU; mC; rG; mU; mC; rU; mC; rG; mC; rA; mU; mC; rU; mU; rG; mU; rC; zc3p; zc3p$ |
| SERPINH1_52_S1566 | | | | | | | zidB; rG; rA; rC; rA; rA; rG; rA; rU; rG; rC; rG; rA; rG; rA; rC2p; rG2p; rA2p; rG2p; rA2p; zc3p$ | mU; rC; mU; mC; rG; mU; mC; rU; mC; rG; mC; rA; rU; mC; mU; mU; rG; mU; rC; zc3p; zc3p$ |
| SERPINH1_52_S1567 | | | | | | | zidB; rG; rA; rC; rA; rA; rG; rA; rU; rG; rC; rG; rA; rG; rA; rC2p; rG2p; rA2p; rG2p; rA2p; zc3p$ | mU; rC; mU; mC; rG; mU; mC; rU; mC; rG; mC; rA; mU; rC; mU; mU; rG; mU; rC; zc3p; zc3p$ |
| SERPINH1_52_S1568 | | | | | | | zidB; rG; rA; rC; rA; rA; rG; rA; rU; rG; rC; rG; rA; rG; rA; rC2p; rG2p; rA2p; rG2p; rA2p; zc3p$ | mU; rC; mU; mC; rG; rU; LdC; rU; mC; rG; mC; rA; rU; mC; mU; mU; rG; mU; rC; zc3p; zc3p$ |
| SERPINH1_52_S1569 | | | | | | | zidB; rG; rA; rC; rA; rA; rG; rA; rU; rG; rC; rG; rA; rG; rA; rC2p; rG2p; rA2p; rG2p; rA2p; zc3p$ | mU; rC; mU; mC; rG; rU; rC2p; rU; mC; rG; mC; rA; rU; mC; mU; mU; rG; mU; rC; zc3p; zc3p$ |
| SERPINH1_52_S1570 | | | | | | | zidB; rG; rA; mC; rA; rA; rG; rA; mU; rG; mC; rG; rA; rG; rA; mC; rG; rA; LdC; rA$ | mU; rC; mU; rC; mG; rU; mC; rU; mC; rG; mC; rA; mU; rC; mU; rU; mG; rU; mC; zc3p; zc3p$ |
| SERPINH1_52_S1571 | | | | | | | zidB; rG; rA; mC; rA; rA; rG; rA; mU; rG; mC; rG; rA; rG; rA; mC; rG; rA; LdG; rA$ | mU; rC; mU; mC; rG; mU; mC; mU; mC; rG; mC; rA; mU; mC; mU; mU; rG; mU; rC; zc3p; zc3p$ |
| SERPINH1_52_S1572 | | | | | | | zidB; rG; rA; mC; rA; rA; rG; rA; mU; rG; mC; rG; rA; rG; rA; mC; rG; rA; LdG; rA$ | mU; rC; mU; mC; rG; mU; mC; rU; mC; rG; mC; rA; mU; mC; rU; mU; rG; mU; rC; zc3p; zc3p$ |
| SERPINH1_52_S1573 | | | | | | | zidB; rG; rA; mC; rA; rA; rG; rA; mU; rG; mC; rG; rA; rG; rA; mC; rG; rA; LdG; rA$ | mU; rC; mU; mC; rG; mU; mC; rU; mC; rG; mC; rA; rU; mC; mU; mU; rG; mU; rC; zc3p; zc3p$ |
| SERPINH1_52_S1574 | | | | | | | zidB; rG; rA; mC; rA; rA; rG; rA; mU; rG; mC; rG; rA; rG; rA; mC; rG; rA; LdG; rA$ | mU; rC; mU; mC; rG; mU; mC; rU; mC; rG; mC; rA; mU; rC; mU; mU; rG; mU; rC; zc3p; zc3p$ |
| SERPINH1_52_S1575 | | | | | | | zidB; rG; rA; mC; rA; rA; rG; rA; mU; rG; mC; rG; rA; rG; rA; mC; rG; rA; LdG; rA$ | mU; rC; mU; mC; rG; rU; LdC; rU; mC; rG; mC; rA; rU; mC; mU; mU; rG; mU; rC; zc3p; zc3p$ |
| SERPINH1_52_S1576 | | | | | | | zidB; rG; rA; mC; rA; rA; rG; rA; mU; rG; mC; rG; rA; rG; rA; mC; rG; rA; LdG; rA$ | mU; rC; mU; mC; rG; rU; rC2p; rU; mC; rG; mC; rA; rU; mC; mU; mU; rG; mU; rC; zc3p; zc3p$ |
| SERPINH1_52_S1577 | | | | | | | zidB; rG; rA; mC; rA; rA; rG; rA; mU; rG; mC; rG; rA; rG; rA; mC; rG; rA; rG; rA; zc3p$ | mU; rC; mU; rC; mG; rU; mC; rU; mC; rG; mC; rA; mU; rC; mU; rU; mG; rU; mC; zc3p; zc3p$ |
| SERPINH1_52_S1578 | | | | | | | zidB; rG; rA; mC; rA; rA; rG; rA; mU; rG; mC; rG; rA; rG; rA; mC; rG; rA; rG; rA; zc3p$ | mU; rC; mU; mC; rG; mU; mC; mU; mC; rG; mC; rA; mU; mC; mU; mU; rG; mU; rC; zc3p; zc3p$ |
| SERPINH1_52_S1579 | | | | | | | zidB; rG; rA; mC; rA; rA; rG; rA; mU; rG; mC; rG; rA; rG; rA; mC; rG; rA; rG; rA; zc3p$ | mU; rC; mU; mC; rG; mU; mC; rU; mC; rG; mC; rA; mU; mC; rU; mU; rG; mU; rC; zc3p; zc3p$ |
| SERPINH1_52_S1580 | | | | | | | zidB; rG; rA; mC; rA; rA; rG; rA; mU; rG; mC; rG; rA; rG; rA; mC; rG; rA; rG; rA; zc3p$ | mU; rC; mU; mC; rG; mU; mC; rU; mC; rG; mC; rA; rU; mC; mU; mU; rG; mU; rC; zc3p; zc3p$ |
| SERPINH1_52_S1581 | | | | | | | zidB; rG; rA; mC; rA; rA; rG; rA; mU; rG; mC; rG; rA; rG; rA; mC; rG; rA; rG; rA; zc3p$ | mU; rC; mU; mC; rG; mU; mC; rU; mC; rG; mC; rA; mU; rC; mU; mU; rG; mU; rC; zc3p; zc3p$ |
| SERPINH1_52_S1582 | | | | | | | zidB; rG; rA; mC; rA; rA; rG; rA; mU; rG; mC; rG; rA; rG; rA; mC; rG; rA; rG; rA; zc3p$ | mU; rC; mU; mC; rG; rU; LdC; rU; mC; rG; mC; rA; rU; mC; mU; mU; rG; mU; rC; zc3p; zc3p$ |
| SERPINH1_52_S1583 | | | | | | | zidB; rG; rA; mC; rA; rA; rG; rA; mU; rG; mC; rG; rA; rG; rA; mC; rG; rA; rG; rA; zc3p$ | mU; rC; mU; mC; rG; rU; rC2p; rU; mC; rG; mC; rA; rU; mC; mU; mU; rG; mU; rC; zc3p; zc3p$ |
| SERPINH1_58_S1391 | | | | | | | zidB; rG; rA; rC; rA; rA; rG; rA; rU; rG; rC; rG; rA; rG; rA; rC2p; rG2p; rA2p; rG2p; rU2p | rA; mC; rU; mC; rG; mU; mC; mU; rC; rG; mC; rA; mU; rC; mU; rU; mG; rU; mC; zc3p; zc3p$ |
| SERPINH1_58_S1584 | | | | | | | zidB; rG; rA; rC; rA; rA; rG; rA; rU; rG; rC; rG; rA; rG; rA; rC2p; rG2p; rA2p; rG2p; rU2p | rA; mC; rU; mC; rG; mU; mC; rU; mC; rG; mC; rA; rU; mC; mU; mU; rG; mU; rC; zc3p; zc3p$ |

TABLE 6-continued

| 1. Name | Stability in plasma (h) | % residual 5 nM 001 | % residual 5 nM 002 | 003 | % residual 25 nM 004 | 006 | Sense strand 5->3 code | AntiSense strand 5->3 code |
|---|---|---|---|---|---|---|---|---|
| SERPINH1_86_S1356 | 16 | 68 | 65 | | | | zidB; rA; rC; rA; rG; rG; rC; rC; rU; rC; rU; rA; rC; rA; rA; rC2p; rU2p; rA2p; rC2p; rA2p | mU; rG; mU; rA; mG; rU; mU; rG; mU; rA; mG; rA; mG; rG; mC; rC; mU; rG; mU; zc3p; zc3p$ |
| SERPINH1_86_S1363 | | | | | | | zc3p; rA; rC; rA; rG; rG; rC; rC; rU; rC; rU; rA; rC; rA; rA; rC2p; rU2p; rA2p; rC2p; rA2p | mU; rG; mU; rA; mG; rU; mU; rG; mU; rA; mG; rA; mG; rG; mC; rC; mU; rG; mU; zc3p; zc3p$ |
| SERPINH1_86_S1370 | | | | | | | zidB; rA; rC; rA; rG; rG; rC; rC; rU; rC; rU; rA; rC; rA; rA; rC2p; rU2p; rA2p; rC2p; rA2p; zc3p$ | mU; rG; mU; rA; mG; rU; mU; rG; mU; rA; mG; rA; mG; rG; mC; rC; mU; rG; mU; zc3p; zc3p$ |
| SERPINH1_86_S1530 | | | | | | | zc3p; rA; rC; rA; rG; rG; rC; rC; rU; rC; rU; rA; rC; rA; rA; rC2p; rU2p; rA2p; rC2p; rA2p | mU; rG; mU; rA; rG; mU; mU; rG; mU; rA; rG; rA; rG; rG; mC; mC; mU; rG; rU; zc3p; zc3p$ |
| SERPINH1_86_S1531 | | 52 | 31 | | | | zc3p; rA; rC; rA; rG; rG; rC; rC; rU; rC; rU; rA; rC; rA; rA; rC2p; rU2p; rA2p; rC2p; rA2p | mU; rG; mU; rA; rG; mU; mU; rG; mU; rA; rG; rA; rG; rG; mC; rC; mU; rG; rU; zc3p; zc3p$ |
| SERPINH1_86_S1532 | | | | | | | zc3p; rA; rC; rA; rG; rG; rC; rC; rU; rC; rU; rA; rC; rA; rA; rC2p; rU2p; rA2p; rC2p; rA2p | mU; rG; mU; rA; rG; rU; LdT; rG; mU; rA; rG; rA; rG; rG; mC; mC; mU; rG; rU; zc3p; zc3p$ |
| SERPINH1_86_S1533 | 8 | 70 | 74 | | | | zc3p; rA; rC; rA; rG; rG; rC; rC; rU; rC; rU; rA; rC; rA; rA; rC2p; rU2p; rA2p; rC2p; rA2p | mU; rG; mU; rA; rG; rU; rU2p; rG; mU; rA; rG; rA; rG; rG; mC; mC; mU; rG; rU; zc3p; zc3p$ |
| SERPINH1_86_S1534 | | | | | | | zidB; rA; rC; rA; rG; rG; rC; rC; rU; rC; rU; rA; rC; rA; rA; rC2p; rU2p; rA2p; rC2p; rA2p | mU; rG; mU; rA; rG; mU; mU; rG; mU; rA; rG; rA; rG; rG; mC; mC; mU; rG; rU; zc3p; zc3p$ |
| SERPINH1_86_S1535 | | | | | | | zidB; rA; rC; rA; rG; rG; rC; rC; rU; rC; rU; rA; rC; rA; rA; rC2p; rU2p; rA2p; rC2p; rA2p | mU; rG; mU; rA; rG; mU; mU; rG; mU; rA; rG; rA; rG; rG; mC; rC; mU; rG; rU; zc3p; zc3p$ |
| SERPINH1_86_S1536 | | | | | | | zidB; rA; rC; rA; rG; rG; rC; rC; rU; rC; rU; rA; rC; rA; rA; rC2p; rU2p; rA2p; rC2p; rA2p | mU; rG; mU; rA; rG; rU; LdT; rG; mU; rA; rG; rA; rG; rG; mC; mC; mU; rG; rU; zc3p; zc3p$ |
| SERPINH1_86_S1537 | | | | | | | zidB; rA; rC; rA; rG; rG; rC; rC; rU; rC; rU; rA; rC; rA; rA; rC2p; rU2p; rA2p; rC2p; rA2p | mU; rG; mU; rA; rG; rU; rU2p; rG; mU; rA; rG; rA; rG; rG; mC; mC; mU; rG; rU; zc3p; zc3p$ |
| SERPINH1_86_S1538 | | | | | | | zidB; rA; rC; rA; rG; rG; rC; rC; rU; rC; rU; rA; rC; rA; rA; rC2p; rU2p; rA2p; rC2p; rA2p; zc3p$ | mU; rG; mU; rA; rG; mU; mU; rG; mU; rA; rG; rA; rG; rG; mC; mC; mU; rG; rU; zc3p; zc3p$ |
| SERPINH1_86_S1539 | | | | | | | zidB; rA; rC; rA; rG; rG; rC; rC; rU; rC; rU; rA; rC; rA; rA; rC2p; rU2p; rA2p; rC2p; rA2p; zc3p$ | mU; rG; mU; rA; rG; mU; mU; rG; mU; rA; rG; rA; rG; rG; mC; rC; mU; rG; rU; zc3p; zc3p$ |
| SERPINH1_86_S1540 | | | | | | | zidB; rA; rC; rA; rG; rG; rC; rC; rU; rC; rU; rA; rC; rA; rA; rC2p; rU2p; rA2p; rC2p; rA2p; zc3p$ | mU; rG; mU; rA; rG; rU; LdT; rG; mU; rA; rG; rA; rG; rG; mC; mC; mU; rG; rU; zc3p; zc3p$ |
| SERPINH1_86_S1541 | | | | | | | zidB; rA; rC; rA; rG; rG; rC; rC; rU; rC; rU; rA; rC; rA; rA; rC2p; rU2p; rA2p; rC2p; rA2p; zc3p$ | mU; rG; mU; rA; rG; rU; rU2p; rG; mU; rA; rG; rA; rG; rG; mC; mC; mU; rG; rU; zc3p; zc3p$ |
| SERPINH1_86_S1542 | | | | | | | zidB; rA; mC; rA; rG; rG; mC; rC; rU; rC; mU; rA; mC; rA; rA; rC; mU; rA; LdC; rA$ | mU; rG; mU; rA; mG; rU; mU; rG; mU; rA; mG; rA; mG; rG; mC; rC; mU; rG; mU; zc3p; zc3p$ |
| SERPINH1_86_S1543 | 8 | 44 | 42 | | | | zidB; rA; mC; rA; rG; rG; mC; rC; rU; rC; mU; rA; mC; rA; rA; rC; mU; rA; LdC; rA$ | mU; rG; mU; rA; rG; mU; mU; rG; mU; rA; rG; rA; rG; rG; mC; mC; mU; rG; rU; zc3p; zc3p$ |
| SERPINH1_86_S1544 | 8 | 29 | 36 | | | | zidB; rA; mC; rA; rG; rG; mC; rC; rU; rC; mU; rA; mC; rA; rA; rC; mU; rA; LdC; rA$ | mU; rG; mU; rA; rG; mU; mU; rG; mU; rA; rG; rA; rG; rG; mC; rC; mU; rG; rU; zc3p; zc3p$ |
| SERPINH1_86_S1545 | | | | | | | zidB; rA; mC; rA; rG; rG; mC; rC; rU; rC; mU; rA; mC; rA; rA; rC; mU; rA; LdC; rA$ | mU; rG; mU; rA; rG; rU; LdT; rG; mU; rA; rG; rA; rG; rG; mC; mC; mU; rG; rU; zc3p; zc3p$ |
| SERPINH1_86_S1546 | 16 | 67 | 63 | | | | zidB; rA; mC; rA; rG; rG; mC; rC; rU; rC; mU; rA; mC; rA; rA; rC; mU; rA; LdC; rA$ | mU; rG; mU; rA; rG; rU; rU2p; rG; mU; rA; rG; rA; rG; rG; mC; mC; mU; rG; rU; zc3p; zc3p$ |
| SERPINH1_86_S1547 | 16 | 24 | 63 | | | | zidB; rA; mC; rA; rG; rG; rC; rC; rU; rC; mU; rA; mC; rA; rA; rC; mU; rA; mC; rA; zc3p$ | mU; rG; mU; rA; mG; rU; mU; rG; mU; rA; mG; rA; mG; rG; mC; rC; mU; rG; mU; zc3p; zc3p$ |
| SERPINH1_86_S1548 | 16 | 39 | 67 | | | | zidB; rA; mC; rA; rG; rG; rC; rC; rU; rC; mU; rA; mC; rA; rA; rC; mU; rA; mC; rA; zc3p$ | mU; rG; mU; rA; rG; mU; mU; rG; mU; rA; rG; rA; rG; rG; mC; mC; mU; rG; rU; zc3p; zc3p$ |
| SERPINH1_86_S1549 | 16 | 20 | 68 | | | | zidB; rA; mC; rA; rG; rG; rC; rC; rU; rC; mU; rA; mC; rA; rA; rC; mU; rA; mC; rA; zc3p$ | mU; rG; mU; rA; rG; mU; mU; rG; mU; rA; rG; rA; rG; rG; mC; rC; mU; rG; rU; zc3p; zc3p$ |
| SERPINH1_86_S1550 | 16 | 96 | 92 | | | | zidB; rA; mC; rA; rG; rG; rC; rC; rU; rC; mU; rA; mC; rA; rA; rC; mU; rA; mC; rA; zc3p$ | mU; rG; mU; rA; rG; rU; LdT; rG; mU; rA; rG; rA; rG; rG; mC; mC; mU; rG; rU; zc3p; zc3p$ |

TABLE 6-continued

| 1. Name | Stability in plasma (h) | % residual 5 nM 001 | 002 | % residual 25 nM 003 | 004 | 006 | Sense strand 5->3 code | AntiSense strand 5->3 code |
|---|---|---|---|---|---|---|---|---|
| SERPINH1_86_S1551 | 16 | 70 | 51 | | | | zidB; rA; mC; rA; rG; rG; rC; rC; rU; rC; mU; rA; mC; rA; rA; rC; mU; rA; mC; rA; zc3p$ | mU; rG; mU; rA; rG; rU; rU2p; rG; mU; rA; rG; rA; rG; rG; mC; mC; mU; rG; rU; zc3p; zc3p$ |
| SERPINH1_2_S1686 | | | | | | | zidB; rG; rA; rG; rA; rC; rA; mC; rA; rU; rG; rG; rG; mU; rG; rC; mU; rA; mU; rA; zc3p$ | mU; rA; mU; rA; mG; rC; mA; rC; mC; rC; mA; rU; mG; rU; mG; rU; mC; rU; mC; zc3p; zc3p$ |
| SERPINH1_2_S1688 | | | | | | | zidB; rG; rA; rG; rA; rC; rA; mC; rA; rU; rG; rG; rG; mU; rG; rC; mU; rA; mU; rA; zc3p$ | mU; rA; mU; rA; mG; rC; rA2p; rC; mC; rC; mA; rU; mG; rU; mG; rU; mC; rU; mC; zc3p; zc3p$ |
| SERPINH1_2_S1689 | | | | | | | zidB; rG; rA; rG; rA; rC; rA; mC; rA; rU; rG; rG; rG; mU; rG; rC; mU; rA; mU; rA; zc3p; zc3p$ | mU; rA; mU; rA; mG; rC; mA; rC; mC; rC; mA; rU; mG; rU; mG; rU; mC; rU; mC; zc3p; zc3p$ |
| SERPINH1_2_S1690 | | | | | | | zidB; rG; rA; rG; rA; rC; rA; mC; rA; rU; rG; rG; rG; mU; rG; rC; mU; rA; mU; rA; zc3p; zc3p$ | mU; rA; mU; rA; mG; rC; mA; rC; mC; rC; mA; rU; mG; rU; mG; rU; mC; rU; rC; zc3p; zc3p$ |
| SERPINH1_2_S1691 | | | | | | | zidB; rG; rA; rG; rA; rC; rA; mC; rA; rU; rG; rG; rG; mU; rG; rC; mU; rA; mU; rA; zc3p; zc3p$ | mU; rA; mU; rA; mG; rC; rA2p; rC; mC; rC; mA; rU; mG; rU; mG; rU; mC; rU; mC; zc3p; zc3p$ |
| SERPINH1_2_S1692 | | | | | | | zidB; rG; rA; rG; rA; rC; rA; mC; rA; rU2p; rG; rG; rG; mU; rG; rC; mU; rA; mU; rA; zc3p$ | mU; rA; mU; rA; mG; rC; mA; rC; mC; rC; mA; rU; mG; rU; mG; rU; mC; rU; mC; zc3p; zc3p$ |
| SERPINH1_2_S1693 | | | | | | | zidB; rG; rA; rG; rA; rC; rA; mC; rA; rU2p; rG; rG; rG; mU; rG; rC; mU; rA; mU; rA; zc3p$ | mU; rA; mU; rA; mG; rC; mA; rC; mC; rC; mA; rU; mG; rU; mG; rU; mC; rU; rC; zc3p; zc3p$ |
| SERPINH1_2_S1695 | | | | | | | zidB; rG; rA; rG; rA; mC; rA; mC; rA; rU; rG; rG; rG; rU; rG; rC; mU; rA; mU; rA; zc3p$ | mU; rA; mU; rA; mG; rC; mA; rC; mC; rC; mA; rU; mG; rU; mG; rU; mC; rU; mC; zc3p; zc3p$ |
| SERPINH1_2_S1696 | | | | | | | zidB; rG; rA; rG; rA; mC; rA; mC; rA; rU; rG; rG; rG; rU; rG; rC; mU; rA; mU; rA; zc3p$ | mU; rA; mU; rA; mG; rC; mA; rC; mC; rC; mA; rU; mG; rU; mG; rU; mC; rU; rC; zc3p; zc3p$ |
| SERPINH1_2_S1697 | | | | | | | zidB; rG; rA; rG; rA; mC; rA; mC; rA; rU; rG; rG; rG; rU; rG; rC; mU; rA; mU; rA; zc3p$ | mU; rA; mU; rA; mG; rC; rA2p; rC; mC; rC; mA; rU; mG; rU; mG; rU; mC; rU; mC; zc3p; zc3p$ |
| SERPINH1_2_S1698 | | | | | | | zidB; rG; rA; rG; rA; mC; rA; mC; rA; rU; rG; rG; rG; mU; rG; rC; mU; rA; rU2p; rA; zc3p$ | mU; rA; mU; rA; mG; rC; mA; rC; mC; rC; mA; rU; mG; rU; mG; rU; mC; rU; mC; zc3p; zc3p$ |
| SERPINH1_2_S1699 | | | | | | | zidB; rG; rA; rG; rA; mC; rA; mC; rA; rU; rG; rG; rG; mU; rG; rC; mU; rA; rU2p; rA; zc3p$ | mU; rA; mU; rA; mG; rC; mA; rC; mC; rC; mA; rU; mG; rU; mG; rU; mC; rU; rC; zc3p; zc3p$ |
| SERPINH1_2_S1701 | | | | | | | zidB; rG; rA; rG; rA; mC; rA; mC; rA; rU; rG; rG; rG; mU; rG; rC; mU; rA; LdT; rA; zc3p$ | mU; rA; mU; rA; mG; rC; mA; rC; mC; rC; mA; rU; mG; rU; mG; rU; mC; rU; mC; zc3p; zc3p$ |
| SERPINH1_2_S1702 | | | | | | | zidB; rG; rA; rG; rA; mC; rA; mC; rA; rU; rG; rG; rG; mU; rG; rC; mU; rA; LdT; rA; zc3p$ | mU; rA; mU; rA; mG; rC; mA; rC; mC; rC; mA; rU; mG; rU; mG; rU; mC; rU; rC; zc3p; zc3p$ |
| SERPINH1_2_S1703 | | | | | | | zidB; rG; rA; rG; rA; mC; rA; mC; rA; rU; rG; rG; rG; mU; rG; rC; mU; rA; LdT; rA; zc3p$ | mU; rA; mU; rA; mG; rC; rA2p; rC; mC; rC; mA; rU; mG; rU; mG; rU; mC; rU; mC; zc3p; zc3p$ |
| SERPINH1_2_S1704 | | | | | | | zidB; rG; rA; rG; rA; rC; rA; rC; rA; rU; rG; rG; rG; rU; rG; rC2p; rU2p; rA2p; rU2p; rA2p | mU; rA; mU; rA; mG; rC; mA; rC; mC; rC; mA; rU; mG; rU; mG; rU; mC; rU; rC; zc3p; zc3p$ |
| SERPINH1_2_S1706 | | | | | | | zidB; rG; rA; rG; rA; rC; rA; rC; rA; rU; rG; rG; rG; rU; rG; rC2p; rU2p; rA2p; rU2p; rA2p; zc3p$ | mU; rA; mU; rA; mG; rC; mA; rC; mC; rC; mA; rU; mG; rU; mG; rU; mC; rU; rC; zc3p; zc3p$ |
| SERPINH1_2_S1708 | | | | | | | zidB; rG; rA; rG; rA; mC; rA; mC; rA; rU; rG; rG; rG; mU; rG; mC; mU; rA; LdT; rA$ | mU; rA; mU; rA; mG; rC; mA; rC; mC; rC; mA; rU; mG; rU; mG; rU; mC; rU; rC; zc3p; zc3p$ |
| SERPINH1_2_S1709 | | | | | | | zidB; rG; rA; rG; rA; mC; rA; mC; rA; rU; rG; rG; rG; mU; rG; mC; mU; rA; LdT; rA$ | mU; rA; mU; rA; mG; rC; rA2p; rC; mC; rC; mA; rU; mG; rU; mG; rU; mC; rU; mC; zc3p; zc3p$ |
| SERPINH1_2_S1710 | | | | | | | zidB; rG; rA; rG; rA; mC; rA; mC; rA; rU; rG; rG; rG; mU; rG; rC; mU; rA; mU; rA; zc3p$ | mU; rA; mU; rA; mG; rC; mA; rC; mC; rC; mA; rU; mG; rU; mG; rU; mC; rU; rC; zc3p; zc3p$ |
| SERPINH1_2_S1711 | | | | | | | zidB; rG; rA; rG; rA; mC; rA; mC; rA; rU; rG; rG; rG; mU; rG; rC; mU; rA; mU; rA; zc3p$ | mU; rA; mU; rA; mG; rC; rA2p; rC; mC; rC; mA; rU; mG; rU; mG; rU; mC; rU; mC; zc3p; zc3p$ |
| SERPINH1_6_S1712 | | | | | | | zidB; rA; mC; rA; rA; rG; rA; mU; rG; rC; rG; rA; rG; rA; mC; rG; rA; rG; LdT; rA; zc3p$ | mU; rA; mC; rU; mC; rG; mU; rC; mU; rC; mG; rC; mA; rU; mC; rU; mU; rG; mU; zc3p; zc3p$ |
| SERPINH1_6_S1713 | | | | | | | zidB; rA; mC; rA; rA; rG; rA; mU; rG; rC; rG; rA; rG; rA; mC; rG; rA; rG; LdT; rA; zc3p$ | mU; rA; mC; rU; mC; rG; mU; mC; rU; mC; rG; mC; mA; rU; mC; rU; mU; rG; rU; zc3p; zc3p$ |

TABLE 6-continued

| 1. Name | Stability in plasma (h) | % residual 5 nM 001 | 002 | % residual 25 nM 003 | 004 | 006 | Sense strand 5->3 code | AntiSense strand 5->3 code |
|---|---|---|---|---|---|---|---|---|
| SERPINH1_6_S1714 | | | | | | | zidB; rA; mC; rA; rA; rG; rA; mU; rG; rC; rG; rA; rG; rA; mC; rG; rA; rG; LdT; rA; zc3p$ | mU; rA; mC; rU; mC; rG; rU2p; rC; mU; rC; rG; mC; mA; rU; mC; rU; mU; rG; rU; zc3p; zc3p$ |
| SERPINH1_6_S1715 | | | | | | | zidB; rA; mC; rA; rA; rG; rA; mU; rG; rC; rG; rA; rG; rA; mC; rG; rA; rG; LdT; rA; zc3p$ | mU; rA; mC; rU; mC; rG; rU2p; rC; mU; rC; mG; rC; mA; rU; mC; rU; mU; rG; rU; zc3p; zc3p$ |
| SERPINH1_6_S1716 | | | | | | | zidB; rA; mC; rA; rA; rG; rA; mU; rG; rC; rG; rA; rG; rA; mC; rG; rA; rG; LdT; rA; zc3p$ | mU; rA; mC; rU; mC; rG; rU2p; rC; mU; rC; mG; rC; mA; rU; mC; rU; mU; rG; mU; zc3p; zc3p$ |
| SERPINH1_6_S1717 | | | | | | | zidB; rA; mC; rA; rA; rG; rA; mU; rG; rC; rG; rA; rG; rA; mC; rG; rA; rG; LdT; rA; zc3p$ | mU; rA; mC; rU; mC; rG; rU2p; rC; mU; rC; rG; mC; mA; rU; rC; rU; mU; rG; rU; zc3p; zc3p$ |
| SERPINH1_6_S1718 | | | | | | | zidB; rA; mC; rA; rA; rG; rA; mU; rG; rC; rG; rA; rG; rA; mC; rG; rA; rG; LdT; rA; zc3p; zc3p$ | mU; rA; mC; rU; mC; rG; mU; rC; mU; rC; mG; rC; mA; rU; mC; rU; mU; rG; mU; zc3p; zc3p$ |
| SERPINH1_6_S1719 | | | | | | | zidB; rA; mC; rA; rA; rG; rA; mU; rG; rC; rG; rA; rG; rA; mC; rG; rA; rG; LdT; rA; zc3p; zc3p$ | mU; rA; mC; rU; mC; rG; mU; mC; rU; mC; rG; mC; mA; rU; mC; rU; mU; rG; rU; zc3p; zc3p$ |
| SERPINH1_6_S1720 | | | | | | | zidB; rA; mC; rA; rA; rG; rA; mU; rG; rC; rG; rA; rG; rA; mC; rG; rA; rG; LdT; rA; zc3p; zc3p$ | mU; rA; mC; rU; mC; rG; rU2p; rC; mU; rC; rG; mC; mA; rU; mC; rU; mU; rG; rU; zc3p; zc3p$ |
| SERPINH1_6_S1721 | | | | | | | zidB; rA; mC; rA; rA; rG; rA; mU; rG; rC; rG; rA; rG; rA; mC; rG; rA; rG; LdT; rA; zc3p; zc3p$ | mU; rA; mC; rU; mC; rG; rU2p; rC; mU; rC; mG; rC; mA; rU; mC; rU; mU; rG; rU; zc3p; zc3p$ |
| SERPINH1_6_S1722 | | | | | | | zidB; rA; mC; rA; rA; rG; rA; mU; rG; rC; rG; rA; rG; rA; mC; rG; rA; rG; LdT; rA; zc3p; zc3p$ | mU; rA; mC; rU; mC; rG; rU2p; rC; mU; rC; mG; rC; mA; rU; mC; rU; mU; rG; mU; zc3p; zc3p$ |
| SERPINH1_6_S1723 | | | | | | | zidB; rA; mC; rA; rA; rG; rA; mU; rG; rC; rG; rA; rG; rA; mC; rG; rA; rG; LdT; rA; zc3p; zc3p$ | mU; rA; mC; rU; mC; rG; rU2p; rC; mU; rC; rG; mC; mA; rU; rC; rU; mU; rG; rU; zc3p; zc3p$ |
| SERPINH1_6_S1724 | | | | | | | zidB; rA; mC; rA; rA; rG; rA; mU; rG; rC; rG; rA; rG; rA; mC; rG; rA; rG; rU2p; rA; zc3p$ | mU; rA; mC; rU; mC; rG; mU; rC; mU; rC; mG; rC; mA; rU; mC; rU; mU; rG; mU; zc3p; zc3p$ |
| SERPINH1_6_S1725 | | | | | | | zidB; rA; mC; rA; rA; rG; rA; mU; rG; rC; rG; rA; rG; rA; mC; rG; rA; rG; rU2p; rA; zc3p$ | mU; rA; mC; rU; mC; rG; mU; mC; rU; mC; rG; mC; mA; rU; mC; rU; mU; rG; rU; zc3p; zc3p$ |
| SERPINH1_6_S1726 | | | | | | | zidB; rA; mC; rA; rA; rG; rA; mU; rG; rC; rG; rA; rG; rA; mC; rG; rA; rG; rU2p; rA; zc3p$ | mU; rA; mC; rU; mC; rG; rU2p; rC; mU; rC; rG; mC; mA; rU; mC; rU; mU; rG; rU; zc3p; zc3p$ |
| SERPINH1_6_S1727 | | | | | | | zidB; rA; mC; rA; rA; rG; rA; mU; rG; rC; rG; rA; rG; rA; mC; rG; rA; rG; rU2p; rA; zc3p$ | mU; rA; mC; rU; mC; rG; rU2p; rC; mU; rC; mG; rC; mA; rU; mC; rU; mU; rG; rU; zc3p; zc3p$ |
| SERPINH1_6_S1728 | | | | | | | zidB; rA; mC; rA; rA; rG; rA; mU; rG; rC; rG; rA; rG; rA; mC; rG; rA; rG; rU2p; rA; zc3p$ | mU; rA; mC; rU; mC; rG; rU2p; rC; mU; rC; mG; rC; mA; rU; mC; rU; mU; rG; mU; zc3p; zc3p$ |
| SERPINH1_6_S1729 | | | | | | | zidB; rA; mC; rA; rA; rG; rA; mU; rG; rC; rG; rA; rG; rA; mC; rG; rA; rG; rU2p; rA; zc3p$ | mU; rA; mC; rU; mC; rG; rU2p; rC; mU; rC; rG; mC; mA; rU; rC; rU; mU; rG; rU; zc3p; zc3p$ |
| SERPINH1_6_S1730 | | | | | | | zidB; rA; mC; rA; rA; rG; rA; mU; rG; rC; rG; rA; rG; rA; mC; rG; rA; rG; rU2p; rA; zc3p; zc3p$ | mU; rA; mC; rU; mC; rG; mU; rC; mU; rC; mG; rC; mA; rU; mC; rU; mU; rG; mU; zc3p; zc3p$ |
| SERPINH1_6_S1731 | | | | | | | zidB; rA; mC; rA; rA; rG; rA; mU; rG; rC; rG; rA; rG; rA; mC; rG; rA; rG; rU2p; rA; zc3p; zc3p$ | mU; rA; mC; rU; mC; rG; mU; mC; rU; mC; rG; mC; mA; rU; mC; rU; mU; rG; rU; zc3p; zc3p$ |
| SERPINH1_6_S1732 | | | | | | | zidB; rA; mC; rA; rA; rG; rA; mU; rG; rC; rG; rA; rG; rA; mC; rG; rA; rG; rU2p; rA; zc3p; zc3p$ | mU; rA; mC; rU; mC; rG; rU2p; rC; mU; rC; rG; mC; mA; rU; mC; rU; mU; rG; rU; zc3p; zc3p$ |
| SERPINH1_6_S1733 | | | | | | | zidB; rA; mC; rA; rA; rG; rA; mU; rG; rC; rG; rA; rG; rA; mC; rG; rA; rG; rU2p; rA; zc3p; zc3p$ | mU; rA; mC; rU; mC; rG; rU2p; rC; mU; rC; mG; rC; mA; rU; mC; rU; mU; rG; rU; zc3p; zc3p$ |
| SERPINH1_6_S1734 | | | | | | | zidB; rA; mC; rA; rA; rG; rA; mU; rG; rC; rG; rA; rG; rA; mC; rG; rA; rG; rU2p; rA; zc3p; zc3p$ | mU; rA; mC; rU; mC; rG; rU2p; rC; mU; rC; mG; rC; mA; rU; mC; rU; mU; rG; mU; zc3p; zc3p$ |
| SERPINH1_6_S1735 | | | | | | | zidB; rA; mC; rA; rA; rG; rA; mU; rG; rC; rG; rA; rG; rA; mC; rG; rA; rG; rU2p; rA; zc3p; zc3p$ | mU; rA; mC; rU; mC; rG; rU2p; rC; mU; rC; rG; mC; mA; rU; rC; rU; mU; rG; rU; zc3p; zc3p$ |
| SERPINH1_6_S1736 | | | | | | | zidB; rA; mC; rA; rA; rG; rA; rU; rG; rC; rG; rA; rG; rA; mC; rG; rA; rG; mU; rA; zc3p$ | mU; rA; mC; rU; mC; rG; mU; rC; mU; rC; mG; rC; mA; rU; mC; rU; mU; rG; mU; zc3p; zc3p$ |
| SERPINH1_6_S1737 | | | | | | | zidB; rA; mC; rA; rA; rG; rA; rU; rG; rC; rG; rA; rG; rA; mC; rG; rA; rG; mU; rA; zc3p$ | mU; rA; mC; rU; mC; rG; mU; mC; rU; mC; rG; mC; mA; rU; mC; rU; mU; rG; rU; zc3p; zc3p$ |

TABLE 6-continued

| 1. Name | Stability in plasma (h) | % residual 5 nM 001 | % residual 5 nM 002 | % residual 25 nM 003 | % residual 25 nM 004 | 006 | Sense strand 5->3 code | AntiSense strand 5->3 code |
|---|---|---|---|---|---|---|---|---|
| SERPINH1_6_S1738 | | | | | | | zidB; rA; mC; rA; rA; rG; rA; rU; rG; rC; rG; rA; rG; rA; mC; rG; rA; rG; mU; rA; zc3p$ | mU; rA; mC; rU; mC; rG; rU2p; rC; mU; rC; rG; mC; mA; rU; mC; rU; mU; rG; rU; zc3p; zc3p$ |
| SERPINH1_6_S1740 | | | | | | | zidB; rA; mC; rA; rA; rG; rA; rU; rG; rC; rG; rA; rG; rA; mC; rG; rA; rG; mU; rA; zc3p$ | mU; rA; mC; rU; mC; rG; rU2p; rC; mU; rC; mG; rC; mA; rU; mC; rU; mU; rG; mU; zc3p; zc3p$ |
| SERPINH1_6_S1742 | | | | | | | zidB; rA; rC; rA; rA; rG; rA; rU; rG; rC; rG; rA; rG; rA; mC; rG; rA; rG; mU; rA; zc3p$ | mU; rA; mC; rU; mC; rG; mU; rC; mU; rC; mG; rC; mA; rU; mC; rU; mU; rG; mU; zc3p; zc3p$ |
| SERPINH1_6_S1743 | | | | | | | zidB; rA; rC; rA; rA; rG; rA; rU; rG; rC; rG; rA; rG; rA; mC; rG; rA; rG; mU; rA; zc3p$ | mU; rA; mC; rU; mC; rG; mU; mC; rU; mC; rG; mC; mA; rU; mC; rU; mU; rG; rU; zc3p; zc3p$ |
| SERPINH1_6_S1745 | | | | | | | zidB; rA; rC; rA; rA; rG; rA; rU; rG; rC; rG; rA; rG; rA; mC; rG; rA; rG; mU; rA; zc3p$ | mU; rA; mC; rU; mC; rG; rU2p; rC; mU; rC; mG; rC; mA; rU; mC; rU; mU; rG; rU; zc3p; zc3p$ |
| SERPINH1_6_S1747 | | | | | | | zidB; rA; rC; rA; rA; rG; rA; rU; rG; rC; rG; rA; rG; rA; mC; rG; rA; rG; mU; rA; zc3p$ | mU; rA; mC; rU; mC; rG; rU2p; rC; mU; rC; rG; mC; mA; rU; rC; rU; mU; rG; rU; zc3p; zc3p$ |
| SERPINH1_6_S1748 | | | | | | | zidB; rA; mC; rA; rA; rG; rA; mU; rG; rC; rG; rA; rG; rA; mC; rG; rA; rG; LdT; rA$ | mU; rA; mC; rU; mC; rG; rU2p; rC; mU; rC; mG; rC; mA; rU; mC; rU; mU; rG; rU; zc3p; zc3p$ |
| SERPINH1_6_S1749 | | | | | | | zidB; rA; mC; rA; rA; rG; rA; mU; rG; rC; rG; rA; rG; rA; mC; rG; rA; rG; LdT; rA$ | mU; rA; mC; rU; mC; rG; rU2p; rC; mU; rC; mG; rC; mA; rU; mC; rU; mU; rG; mU; zc3p; zc3p$ |
| SERPINH1_6_S1750 | | | | | | | zidB; rA; mC; rA; rA; rG; rA; mU; rG; rC; rG; rA; rG; rA; mC; rG; rA; rG; LdT; rA$ | mU; rA; mC; rU; mC; rG; rU2p; rC; mU; rC; rG; mC; mA; rU; rC; rU; mU; rG; rU; zc3p; zc3p$ |
| SERPINH1_6_S1751 | | | | | | | zidB; rA; mC; rA; rA; rG; rA; mU; rG; rC; rG; rA; rG; rA; mC; rG; rA; rG; mU; rA; zc3p$ | mU; rA; mC; rU; mC; rG; rU2p; rC; mU; rC; mG; rC; mA; rU; mC; rU; mU; rG; rU; zc3p; zc3p$ |
| SERPINH1_6_S1752 | | | | | | | zidB; rA; mC; rA; rA; rG; rA; mU; rG; rC; rG; rA; rG; rA; mC; rG; rA; rG; mU; rA; zc3p$ | mU; rA; mC; rU; mC; rG; rU2p; rC; mU; rC; mG; rC; mA; rU; mC; rU; mU; rG; mU; zc3p; zc3p$ |
| SERPINH1_6_S1753 | | | | | | | zidB; rA; mC; rA; rA; rG; rA; mU; rG; rC; rG; rA; rG; rA; mC; rG; rA; rG; mU; rA; zc3p$ | mU; rA; mC; rU; mC; rG; rU2p; rC; mU; rC; rG; mC; mA; rU; rC; rU; mU; rG; rU; zc3p; zc3p$ |
| SERPINH1_42_S1354 | | | | | | | rG; rA; rC; rA; rG; rG; rC; rC; rU; rC; rU; rA; rC; rA; rA; rC; rU; rA; yrU; zdT; zdT$ | yrA; rU; rA; rG; rU; rU; rG; rU; rA; rG; rA; rG; rG; rC; rC; rU; rG; rU; rC; zdT; zdT$ |
| SERPINH1_51_S1671 | | | | | | | zidB; rU; rC; rC; mU; rG; rA; rG; rA; rC; rA; mC; rA; mU; rG; rG; rG; mU; rG; rA; zc3p$ | mU; rC; rA; mC; rC; rC2p; rA; mU; rG; rU; rG; mU; mC; rU; mC; rA; rG; rG; rA; zc3p; zc3p$ |
| SERPINH1_51_S1672 | | | | | | | zidB; rU; rC; rC; mU; rG; rA; rG; rA; rC; rA; mC; rA; mU; rG; rG; rG; mU; rG; rA; zc3p$ | mU; rC; rA; mC; rC; LdC; rA; mU; rG; rU; rG; mU; mC; rU; mC; rA; rG; rG; rA; zc3p; zc3p$ |
| SERPINH1_51_S1681 | | | | | | | zidB; rU; mC; rC; mU; rG; rA; rG; rA; rC; rA; mC; rA; mU; rG; rG; rG; mU; rG; rA; zc3p$ | mU; rC; rA; mC; rC; rC2p; rA; mU; rG; rU; rG; rU; mC; rU; mC; rA; rG; rG; rA; zc3p; zc3p$ |
| SERPINH1_51_S1683 | | | | | | | zidB; rU; mC; rC; mU; rG; rA; rG; rA; rC; rA; mC; rA; mU; rG; rG; rG; mU; rG; rA; zc3p$ | mU; rC; mA; rC; rC; rC2p; rA; mU; rG; rU; rG; mU; mC; rU; mC; rA; rG; rG; rA; zc3p; zc3p$ |

TABLE 7

Code of the modified nucleotides/unconventional moieties as used in the Tables herein.

| Code | Description |
|---|---|
| rA | riboadenosine-3'-phosphate; 3'-adenylic acid |
| rC | ribocytidine-3'-phosphate; 3'-cytidylic acid |
| rG | riboguanosine-3'-phosphate; 3'-guanylic acid |
| rU | ribouridine-3'-phosphate; 3'-uridylic acid |
| mA | 2'-O-methyladenosine-3'-phosphate; 2'-O-methyl-3'-adenylic acid |
| mC | 2'-O-methylcytidine-3'-phosphate; 2'-O-methyl-3'-cytidylic acid |
| mG | 2'-O-methylguanosine-3'-phosphate; 2'-O-methyl-3'-guanylic acid |
| mU | 2'-O-methyluridine-3'-phosphate; 2'-O-methyl-3'-uridylic acid |
| dA | deoxyriboadenosine-3'-phosphate; 2'-deoxyribo-3'-adenylic acid |
| dC | deoxyribocytidine-3'-phosphate; 2'-deoxyribo-3'-cytidylic acid |
| dG | deoxyriboguanosine-3'-phosphate; 2'-deoxyribo-3'-guanylic acid |
| dT | thymidine-3'-phosphate; 3'-thymidylic acid |
| rA2p | riboadenosine-2'-phosphate; 2'-adenylic acid (2'5' A) |
| rC2p | ribocytidine-2'-phosphate; 2'-cytidylic acid (2'5' C) |
| rG2p | riboguanosine-2'-phosphate; 2'-guanylic acid (2'5' G) |
| rU2p | ribouridine-2'-phosphate; 2'-uridylic acid (2'5'U) |
| LdA | L-deoxyriboadenosine-3'-phosphate (mirror image dA) |
| LdC | L-deoxyribocytidine-3'-phosphate (mirror image dC) |
| LdG | L-deoxyriboguanosine-3'-phosphate (mirror image dG) |
| LdT | L-deoxyribothymidine-3'-phosphate (mirror image dT) |
| dB | abasic deoxyribose-3'-phosphate; 1,2-dideoxy-D-ribofuranose-3-phosphate; 1,4-2-deoxy-D-ribitol-3-phosphate |
| zidB | Inverted abasic deoxyribose-5'-phosphate; At 5' = 5'-5' idAb; |

TABLE 7-continued

Code of the modified nucleotides/unconventional moieties as used in the Tables herein.

| Code | Description |
|---|---|
| At 3' = 3'-3' idAb | |
| z | Prefix to indicate moiety covalently attached to 3' terminus or 5' terminus |
| psiU | pseudouridne |
| p | 5' phosphate |
| s | 5' phosphorothioate |
| C3 | C3 non-nucleotide |
| $ | lacking a 3' linker (used together with above nucleotides at the 3' end of the sequence) | siRNA oligonucleotides useful in generating double stranded RNA molecules are disclosed in Tables A-18, A-19 and B-E below.

SERPINH1 Oligonucleotide Sequence Useful in the Preparation of siRNA Compounds.

TABLE A-18

| Name | SEQ ID NO SEN | Sense (5' > 3') | SEQ ID NO AS | Antisense (5' > 3') | Cross Species | Ident Human gi"32454740 |
|---|---|---|---|---|---|---|
| SERPINH1_2 | 60 | GAGACACAUGGGUGCUAUA | 127 | UAUAGCACCCAUGUGUCUC | H, Rt, Rh, M, D | [1533-1551] (18/19) |
| SERPINH1_3 | 61 | GGGAAGAUGCAGAAGAAGA | 128 | UCUUCUUCUGCAUCUUCCC | H, Rt, Rh, Rb | [1112-1130] (18/19) |
| SERPINH1_5 | 62 | GAAGAAGGCUGUUGCCAUA | 129 | UAUGGCAACAGCCUUCUUC | H, Rt | [1123-1141] (18/19) |
| SERPINH1_6 | 63 | ACAAGAUGCGAGACGAGUA | 130 | UACUCGUCUCGCAUCUUGU | H, Rt, Rh, | [1464-1482] (18/19) |
| SERPINH1_7 | 64 | GGACAACCGUGGCUUCAUA | 131 | UAUGAAGCCACGGUUGUCC | H, Rh, M | [886-904] (18/19) |
| SERPINH1_8 | 65 | UGCAGUCCAUCAACGAGUA | 132 | UACUCGUUGAUGGACUGCA | H, Rt, Rh, M | [738-756] (18/19) |
| SERPINH1_9 | 66 | GCCUCAUCAUCCUCAUGCA | 133 | UGCAUGAGGAUGAUGAGGC | H, Rt, Rh, M, D | [1026-1044] (18/19) |
| SERPINH1_10 | 67 | CGCGCUGCAGUCCAUCAAA | 134 | UUUGAUGGACUGCAGCGCG | H, Rt, Rh | [733-751] (18/19) |
| SERPINH1_11 | 68 | CGGACAGGCCUCUACAACA | 135 | UGUUGUAGAGGCCUGUCCG | H, Rt, Rh, P | [944-962] (18/19) |
| SERPINH1_13 | 69 | UGACAAGAUGCGAGACGAA | 136 | UUCGUCUCGCAUCUUGUCA | H, Rh | [1462-1480] (18/19) |
| SERPINH1_14 | 70 | CCAGCCUCAUCAUCCUCAA | 137 | UUGAGGAUGAUGAGGCUGG | H, M, Rt, Rh, D- | [1023-1041] (18/19) |
| SERPINH1_15 | 71 | GCUGCAGUCCAUCAACGAA | 138 | UUCGUUGAUGGACUGCAGC | H, Rt, Rh | [736-754] (18/19) |
| SERPINH1_16 | 72 | GCAGCGCGCUGCAGUCCAA | 139 | UUGGACUGCAGCGCGCUGC | H, Rt, Rh | [729-747] (18/19) |
| SERPINH1_17 | 73 | UGAGACACAUGGGUGCUAA | 140 | UUAGCACCCAUGUGUCUCA | H, Rt, Rh, M, D | [1532-1550] (18/19) |
| SERPINH1_19 | 74 | GGUGGAGGUGACCCAUGAA | 141 | UUCAUGGGUCACCUCCACC | H, Rt, Rh, M | [1159-1177] (18/19) |
| SERPINH1_20 | 75 | CUUUGACCAGGACAUCUAA | 142 | UUAGAUGUCCUGGUCAAAG | H, Rt, Rh | [1324-1342] (18/19) |
| SERPINH1_21 | 76 | GGAGGUGACCCAUGACCUA | 143 | UAGGUCAUGGGUCACCUCC | H, Rt, Rh, M, D | [1162-1180] (18/19) |
| SERPINH1_22 | 77 | CUCCUGAGACACAUGGGUA | 144 | UACCCAUGUGUCUCAGGAG | H, D | [1528-1546] (18/19) |
| SERPINH1_23 | 78 | AGAAGAAGGCUGUUGCCAA | 145 | UUGGCAACAGCCUUCUUCU | H, Rt | [1122-1140] (18/19) |

TABLE A-18-continued

| | | | | | | |
|---|---|---|---|---|---|---|
| SERPINH1_24 | 79 | AGCUCUCCAGCCUCAUCAA | 146 | UUGAUGAGGCUGGAGAGCU | H, Rt, D, M, P, Rh | [1017-1035] (18/19) |
| SERPINH1_25 | 80 | CUGCAGUCCAUCAACGAGA | 147 | UCUCGUUGAUGGACUGCAG | H, Rt, Rh M | [737-755] (18/19) |
| SERPINH1_26 | 81 | CCGGACAGGCCUCUACAAA | 148 | UUUGUAGAGGCCUGUCCGG | H, Rt, Rh, Rb, P | [943-961] (18/19) |
| SERPINH1_27 | 82 | GCACCGGACAGGCCUCUAA | 149 | UUAGAGGCCUGUCCGGUGC | H, Rt, Rh, Rb, P | [940-958] (18/19) |
| SERPINH1_28 | 83 | GCAGAAGAAGGCUGUUGCA | 150 | UGCAACAGCCUUCUUCUGC | H, Rt | [1120-1138] (18/19) |
| SERPINH1_31 | 84 | AGAAGGCUGUUGCCAUCUA | 151 | UAGAUGGCAACAGCCUUCU | H, Rt | [1125-1143] (18/19) |
| SERPINH1_32 | 85 | AGCGCAGCGCGCUGCAGUA | 152 | UACUGCAGCGCGCUGCGCU | H, Rt, Rh, | [726-744] (18/19) |
| SERPINH1_33 | 86 | GACACAUGGGUGCUAUUGA | 153 | UCAAUAGCACCCAUGUGUC | H, Rt, Rh, M | [1535-1553] (18/19) |
| SERPINH1_34 | 87 | GGGCCUGACUGAGGCCAUA | 154 | UAUGGCCUCAGUCAGGCCC | H, Rt | [1201-1219] (18/19) |
| SERPINH1_35 | 88 | AGACACAUGGGUGCUAUUA | 155 | UAAUAGCACCCAUGUGUCU | H, Rt, Rh, M | [1534-1552] (18/19) |
| SERPINH1_36 | 89 | CCAUGACCUGCAGAAACAA | 156 | UUGUUUCUGCAGGUCAUGG | H, Rt, Rh, M | [1171-1189] (18/19) |
| SERPINH1_37 | 90 | AGAUGCAGAAGAAGGCUGA | 157 | UCAGCCUUCUUCUGCAUCU | H, Rt, Rh, M | [1116-1134] (18/19) |
| SERPINH1_38 | 91 | CAAGCUCUCCAGCCUCAUA | 158 | UAUGAGGCUGGAGAGCUUG | H, Rt, Rh, M, P, D | [1015-1033] (18/19) |
| SERPINH1_39 | 92 | UGCAGAAGAAGGCUGUUGA | 159 | UCAACAGCCUUCUUCUGCA | H, Rt | [1119-1137] (18/19) |
| SERPINH1_41 | 93 | CAGCCUCAUCAUCCUCAUA | 160 | UAUGAGGAUGAUGAGGCUG | H, Rt, Rh, M, D | [1024-1042] (18/19) |
| SERPINH1_42 | 94 | GACAGGCCUCUACAACUAA | 161 | UUAGUUGUAGAGGCCUGUC | H, Rt, Rh, Rb, P | [946-964] (18/19) |
| SERPINH1_43 | 95 | GAUGCAGAAGAAGGCUGUA | 162 | UACAGCCUUCUUCUGCAUC | H, Rt, Rh, M | [1117-1135] (18/19) |
| SERPINH1_44 | 96 | ACCCAUGACCUGCAGAAAA | 163 | UUUUCUGCAGGUCAUGGGU | H, Rt, Rh, M | [1169-1187] (18/19) |
| SERPINH1_45 | 97 | ACUCCAAGAUCAACUUCCA | 164 | UGGAAGUUGAUCUUGGAGU | H, Rt, Rh, M, D | [702-720] (18/19) |
| SERPINH1_45a | 98 | ACUCCAAGAUCAACUUCCU | 165 | AGGAAGUUGAUCUUGGAGU | H, Rt, Rh, M, D | [702-720] (18/19) |
| SERPINH1_48 | 99 | AGGCCUCUACAACUACUAA | 166 | UUAGUAGUUGUAGAGGCCU | H, Rt, Rh, Rb, P, D | [949-967] (18/19) |
| SERPINH1_49 | 100 | CACUCCAAGAUCAACUUCA | 167 | UGAAGUUGAUCUUGGAGUG | H, Rt, Rh, M, D | [701-719] (18/19) |
| SERPINH1_51 | 101 | UCCUGAGACACAUGGGUGA | 168 | UCACCCAUGUGUCUCAGGA | H, Rt, D, M | [1529-1547] (18/19) |
| SERPINH1_52 | 102 | GACAAGAUGCGAGACGAGA | 169 | UCUCGUCUCGCAUCUUGUC | H, Rt, Rh, | [1463-1481] (18/19) |
| SERPINH1_53 | 103 | GGUGACCCAUGACCUGCAA | 170 | UUGCAGGUCAUGGGUCACC | H, Rt, Rh, M | [1165-1183] (18/19) |
| SERPINH1_59 | 104 | CCGAGGUGAAGAAACCUGA | 171 | UCAGGUUUCUUCACCUCGG | H, Rt, Rh, | [285-303] (18/19) |
| SERPINH1_51a | 105 | UCCUGAGACACAUGGGUGU | 172 | ACACCCAUGUGUCUCAGGA | H, Rt, D, M | [1529-1547] (18/19) |

TABLE A-18-continued

| siRNA | SEQ ID | Sense | SEQ ID | Antisense | Species | Position |
|---|---|---|---|---|---|---|
| SERPINH1_61 | 106 | GCACUCCAAGAUCAACUUA | 173 | UAAGUUGAUCUUGGAGUGC | H, Rh, D | [700-718] (18/19) |
| SERPINH1_62 | 107 | GUGGUGGAGGUGACCCAUA | 174 | UAUGGGUCACCUCCACCAC | H, Rt, Rh, M, Rb | [1157-1175] (18/19) |
| SERPINH1_64 | 108 | GCCGAGGUGAAGAAACCUA | 175 | UAGGUUUCUUCACCUCGGC | H, Rt, Rh, | [284-302] (18/19) |
| SERPINH1_65 | 109 | GCUCUCCAGCCUCAUCAUA | 176 | UAUGAUGAGGCUGGAGAGC | H, Rt, D, M, P, Rh | [1018-1036] (18/19) |
| SERPINH1_66 | 110 | GAUGCACCGGACAGGCCUA | 177 | UAGGCCUGUCCGGUGCAUC | H, Rt, Rh, M, Rb, P | [937-955] (18/19) |
| SERPINH1_68 | 111 | CUCUCCAGCCUCAUCAUCA | 178 | UGAUGAUGAGGCUGGAGAG | H, Rt, D, M, P, Rh | [1019-1037] (18/19) |
| SERPINH1_69 | 112 | GCAGACCACCGACGGCAAA | 179 | UUUGCCGUCGGUGGUCUGC | H, Rt, D | [763-781] (18/19) |
| SERPINH1_70 | 113 | AGUCCAUCAACGAGUGGGA | 180 | UCCCACUCGUUGAUGGACU | H, Rt, Rh, M | [741-759] (18/19) |
| SERPINH1_71 | 114 | ACCGUGGCUUCAUGGUGAA | 181 | UUCACCAUGAAGCCACGGU | H, Rt, Rh, M | [891-909] (18/19) |
| SERPINH1_74 | 115 | GAAGGCUGUUGCCAUCUCA | 182 | UGAGAUGGCAACAGCCUUC | H, Rt, | [1126-1144] (18/19) |
| SERPINH1_75 | 116 | GAAGAUGCAGAAGAAGGCA | 183 | UGCCUUCUUCUGCAUCUUC | H, Rt, Rh, Rb | [1114-1132] (18/19) |
| SERPINH1_77 | 117 | UGAUGAUGCACCGGACAGA | 184 | UCUGUCCGGUGCAUCAUCA | H, Rh, | [933-951] (18/19) |
| SERPINH1_78 | 118 | CCCUUUGACCAGGACAUCA | 185 | UGAUGUCCUGGUCAAAGGG | H, Rt, Rh, | [1322-1340] (18/19) |
| SERPINH1_80 | 119 | CAGUCCAUCAACGAGUGGA | 186 | UCCACUCGUUGAUGGACUG | H, Rt, Rh, M | [740-758] (18/19) |
| SERPINH1_82 | 120 | CAACCGUGGCUUCAUGGUA | 187 | UACCAUGAAGCCACGGUUG | H, Rt, Rh, M | [889-907] (18/19) |
| SERPINH1_83 | 121 | CGACAAGCGCAGCGCGCUA | 188 | UAGCGCGCUGCGCUUGUCG | H | [721-739] (18/19) |
| SERPINH1_84 | 122 | GCAGUCCAUCAACGAGUGA | 189 | UCACUCGUUGAUGGACUGC | H, Rt, Rh, M | [739-757] (18/19) |
| SERPINH1_86 | 123 | ACAGGCCUCUACAACUACA | 190 | UGUAGUUGUAGAGGCCUGU | H, Rt, Rh, Rb, P, D | [947-965] (18/19) |
| SERPINH1_87 | 124 | AAGAUGCAGAAGAAGGCUA | 191 | UAGCCUUCUUCUGCAUCUU | H, Rt, Rh, M | [1115-1133] (18/19) |
| SERPINH1_89 | 125 | CAGCGCGCUGCAGUCCAUA | 192 | UAUGGACUGCAGCGCGCUG | H, Rt, Rh, | [730-748] (18/19) |
| SERPINH1_90 | 126 | GCGCAGCGCGCUGCAGUCA | 193 | UGACUGCAGCGCGCUGCGC | H, Rt, Rh, | [727-745] (18/19) |

Select siRNAs

| siRNA | SEQ ID SEN | SEQ ID AS | Activity 0.1 nM | Activity 0.5 nM | Activity 5 nM | IC50 (nM) | Length |
|---|---|---|---|---|---|---|---|
| SERPINH1_2 | 60 | 127 | 65 | 48 | 7 | .008 | 19 |
| SERPINH1_6 | 63 | 130 | 164 | 39 | 5 | .019 | 19 |
| SERPINH1_11 | 68 | 135 | 119 | 54 | 6 | .05 | 19 |
| SERPINH1_13 | 69 | 136 | 91 | 24 | 4 | | 19 |
| SERPINH1_45 | 97 | 164 | 156 | 38 | 8 | .07 | 19 |
| SERPINH1_45a | 98 | 165 | | | | | 19 |

TABLE A-18-continued

| siRNA | | | | | | | |
|---|---|---|---|---|---|---|---|
| SERPINH1_51 | 101 | 168 | 68 | 39 | 5 | .05 | 19 |
| SERPINH1_52 | 102 | 169 | 149 | 37 | 9 | 0.06 | 19 |
| SERPINH1_86 | 123 | 190 | 121 | 61 | | 0.27 | 19 |

| siRNA | SEQ ID SEN | SEQ ID AS | Activity 0.026 nM | Activity 0.077 nM | Activity 0.23 nM | Activity 0.69 nM | Activity 2.1 nM | Activity 6.25 nM | Activity 25 nM |
|---|---|---|---|---|---|---|---|---|---|
| SERPINH1_45 | 97 | 164 | 102 | 81 | 55 | 41 | 28 | 22 | 16 |
| SERPINH1_45a | 98 | 165 | 107 | 98 | 84 | 69 | 36 | 24 | 16 |

TABLE A-19

| Name | SEQ ID NO SEN | Sense (5' > 3') | SEQ ID NO AS | Antisense (5' > 3') | Species | L | Ident Human gi 32454740 |
|---|---|---|---|---|---|---|---|
| SERPINH1_1 | 194 | GGACAGGCCUCUACAACUA | 219 | UAGUUGUAGAGGCCUGUCC | H, Rt, Rh, Rb, P | 19 | [945-963] (19/19) |
| SERPINH1_4 | 195 | GAGACACAUGGGUGCUAUU | 220 | AAUAGCACCCAUGUGUCUC | H, Rt, Rh, M, D | 19 | [1533-1551] (19/19) |
| SERPINH1_12 | 196 | ACAAGAUGCGAGACGAGUU | 221 | AACUCGUCUCGCAUCUUGU | H, Rt, Rh, | 19 | [1464-1482] (19/19) |
| SERPINH1_18 | 197 | CCUUUGACCAGGACAUCUA | 222 | UAGAUGUCCUGGUCAAAGG | H, Rt, Rh, | 19 | [1323-1341] (19/19) |
| SERPINH1_29 | 198 | GACCCAUGACCUGCAGAAA | 223 | UUUCUGCAGGUCAUGGGUC | H, Rt, Rh, M | 19 | [1168-1186] (19/19) |
| SERPINH1_30 | 199 | CGGACAGGCCUCUACAACU | 224 | AGUUGUAGAGGCCUGUCCG | H, Rt, Rh, Rb, P | 19 | [944-962] (19/19) |
| SERPINH1_40 | 200 | ACCGGACAGGCCUCUACAA | 225 | UUGUAGAGGCCUGUCCGGU | H, Rt, Rh, Rb, P, | 19 | [942-960] (19/19) |
| SERPINH1_46 | 201 | GCAGCGCGCUGCAGUCCAU | 226 | AUGGACUGCAGCGCGCUGC | H, Rt, Rh, | 19 | [729-747] (19/19) |
| SERPINH1_47 | 202 | GCGCGCUGCAGUCCAUCAA | 227 | UUGAUGGACUGCAGCGCGC | H, Rt, Rh, | 19 | [732-750] (19/19) |
| SERPINH1_50 | 203 | CUGAGACACAUGGGUGCUA | 228 | UAGCACCCAUGUGUCUCAG | H, Rt, Rh, M, D | 19 | [1531-1549] (19/19) |
| SERPINH1_54 | 204 | AGAAGAAGGCUGUUGCCAU | 229 | AUGGCAACAGCCUUCUUCU | H, Rt | 19 | [1122-1140] (19/19) |
| SERPINH1_55 | 205 | AGCUCUCCAGCCUCAUCAU | 230 | AUGAUGAGGCUGGAGAGCU | H, Rt, D, M, P, Rh | 19 | [1017-1035] (19/19) |
| SERPINH1_56 | 206 | CUGCAGUCCAUCAACGAGU | 231 | ACUCGUUGAUGGACUGCAG | H, Rt, Rh, M | 19 | [737-755] (19/19) |
| SERPINH1_57 | 207 | CGCUGCAGUCCAUCAACGA | 232 | UCGUUGAUGGACUGCAGCG | H, Rt, Rh, | 19 | [735-753] (19/19) |
| SERPINH1_58 | 208 | GACAAGAUGCGAGACGAGU | 233 | ACUCGUCUCGCAUCUUGUC | H, Rt, Rh, | 19 | [1463-1481] (19/19) |
| SERPINH1_63 | 209 | GGGCCUGACUGAGGCCAUU | 234 | AAUGGCCUCAGUCAGGCCC | H, Rt | 19 | [1201-1219] (19/19) |
| SERPINH1_67 | 210 | GAUGCAGAAGAAGGCUGUU | 235 | AACAGCCUUCUUCUGCAUC | H, Rt, Rh, M | 19 | [1117-1135] (19/19) |
| SERPINH1_72 | 211 | CACCGGACAGGCCUCUACA | 236 | UGUAGAGGCCUGUCCGGUG | H, Rt, Rh, Rb, P | 19 | [941-959] (19/19) |

TABLE A-19-continued

| siRNA | SEQ ID | Sense | SEQ ID | AntiSense | Other | Length | human- |
|---|---|---|---|---|---|---|---|
| SERPINH1_73 | 212 | AGAUGCAGAAGAAGGCUGU | 237 | ACAGCCUUCUUCUGCAUCU | H, Rt, Rh M | 19 | [1116-1134] (19/19) |
| SERPINH1_76 | 713 | AGCGCGCUGCAGUCCAUCA | 238 | UGAUGGACUGCAGCGCGCU | H, Rt, Rh | 19 | [731-749] (19/19) |
| SERPINH1_79 | 214 | GGAAGAUGCAGAAGAAGGC | 239 | GCCUUCUUCUGCAUCUUCC | H, Rt, Rh, Rb | 19 | [1113-1131] (19/19) |
| SERPINH1_81 | 215 | GAAGAAGGCUGUUGCCAUC | 240 | GAUGGCAACAGCCUUCUUC | H, Rt | 19 | [1123-1141] (19/19) |
| SERPINH1_85 | 216 | UGCAGUCCAUCAACGAGUG | 241 | CACUCGUUGAUGGACUGCA | H, Rt, Rh, M | 19 | [738-756] (19/19) |
| SERPINH1_88 | 217 | CCUGAGACACAUGGGUGCU | 242 | AGCACCCAUGUGUCUCAGG | H, Rt, D, M | 19 | [1530-1548] (19/19) |
| SERPINH1_91 | 218 | CGCAGCGCGCUGCAGUCCA | 243 | UGGACUGCAGCGCGCUGCG | H, Rt, Rh, | 19 | [728-746] (19/19) |

Select siRNAs

| siRNA | SEQ ID NO SEN | SEQ ID NO AS | Activity 0.1 nM | Activity 0.5 nM | Activity 5 nM | IC50 (nM) | Length |
|---|---|---|---|---|---|---|---|
| SERPINH1_4 | 195 | 220 | 60 | 35 | 5 | .006 | 19 |
| SERPINH1_12 | 196 | 221 | 54 | 42 | 8 | .065 | 19 |
| SERPINH1_18 | 197 | 222 | 139 | 43 | 9 |  | 19 |
| SERPINH1_30 | 199 | 224 | 146 | 49 | 9 | 0.093 | 19 |
| SERPINH1_58 | 208 | 233 | na | na | 8 |  | 19 |
| SERPINH1_88 | 217 | 242 | 105 | 43 | 9 |  | 19 |

TABLE B

Additional Active 19-mer SERPINH1 siRNAs

| No | SEQ ID SEN | Sense siRNA | SEQ ID AS | AntiSense siRNA | Other | human- |
|---|---|---|---|---|---|---|
| 1 | 244 | GGCAGACUCUGGUCAAGAA | 460 | UUCUUGACCAGAGUCUGCC | Rh | [2009-2027] |
| 2 | 245 | CAGUGAGGCGGAUUGAGAA | 461 | UUCUCAAUCCGCCUCACUG |  | [1967-1985] |
| 3 | 246 | AGCCUUUGUUGCUAUCAAU | 462 | AUUGAUAGCAACAAAGGCU | Rh | [2117-2135] |
| 4 | 247 | CCAUGUUCUUCAAGCCACA | 463 | UGUGGCUUGAAGAACAUGG | Rh, Rb, D | [837-855] |
| 5 | 248 | CCCUCUUCUGACACUAAAA | 464 | UUUUAGUGUCAGAAGAGGG |  | [1850-1868] |
| 6 | 249 | CCUCAAUCAGUAUUCAUAU | 465 | AUAUGAAUACUGAUUGAGG |  | [1774-1792] |
| 7 | 250 | GAGACACAUGGGUGCUAUU | 466 | AAUAGCACCCAUGUGUCUC | Rh, D, Rt, M | [1533-1551] |
| 8 | 251 | GUGACAAGAUGCGAGACGA | 467 | UCGUCUCGCAUCUUGUCAC | Rh | [1461-1479] |
| 9 | 252 | GCCACACUGGGAUGAGAAA | 468 | UUUCUCAUCCCAGUGUGGC | Rh, Rb, M | [850-868] |
| 10 | 253 | AGAUGCGAGACGAGUUAUA | 469 | UAUAACUCGUCUCGCAUCU | Rh | [1467-1485] |
| 11 | 254 | ACGACGACGAGAAGGAAAA | 470 | UUUUCCUUCUCGUCGUCGU |  | [966-984] |
| 12 | 255 | GCCUCUACAACUACUACGA | 471 | UCGUAGUAGUUGUAGAGGC | Rb, D | [951-969] |
| 13 | 256 | AGAUCAACUUCCGCGACAA | 472 | UUGUCGCGGAAGUUGAUCU | D | [708-726] |
| 14 | 257 | ACUACUACGACGACGAGAA | 473 | UUCUCGUCGUCGUAGUAGU | Rb | [960-978] |
| 15 | 258 | AGCCCUCUUCUGACACUAA | 474 | UUAGUGUCAGAAGAGGGCU |  | [1848-1866] |
| 16 | 259 | ACAAGAUGCGAGACGAGUU | 475 | AACUCGUCUCGCAUCUUGU | Rh, Rt | [1464-1482] |

TABLE B-continued

Additional Active 19-mer SERPINH1 siRNAs

| No | SEQ ID SEN | Sense siRNA | SEQ ID AS | AntiSense siRNA | Other | human- |
|---|---|---|---|---|---|---|
| 17 | 260 | AGCCACACUGGGAUGAGAA | 476 | UUCUCAUCCCAGUGUGGCU | Rh, Rb, M | [849-867] |
| 18 | 261 | AGGACCAGGCAGUGGAGAA | 477 | UUCUCCACUGCCUGGUCCU | Rh | [408-426] |
| 19 | 262 | CAGGCAAGAAGGACCUGUA | 478 | UACAGGUCCUUCUUGCCUG | Rh, D | [1251-1269] |
| 20 | 263 | ACCUGUGAGACCAAAUUGA | 479 | UCAAUUUGGUCUCACAGGU | Rh | [1813-1831] |
| 21 | 264 | CUUUGUUGCUAUCAAUCCA | 480 | UGGAUUGAUAGCAACAAAG | Rh | [2120-2138] |
| 22 | 265 | GUGAGACCAAAUUGAGCUA | 481 | UAGCUCAAUUuGGUCUCAC | Rh | [1817-1835] |
| 23 | 266 | CCCUGAAAGUCCCAGAUCA | 482 | UGAUCUGGGACUUUCAGGG |  | [1749-1767] |
| 24 | 267 | CCUUUGACCAGGACAUCUA | 483 | UAGAUGUCCUGGUCAAAGG | Rh, Rt | [1323-1341] |
| 25 | 268 | GACCAGGCAGUGGAGAACA | 484 | UGUUCUCCACUGCCUGGUC | Rh | [410-428] |
| 26 | 269 | CGCGCAACGUGACCUGGAA | 485 | UUCCAGGUCACGUUGCGCG | M | [597-615] |
| 27 | 270 | AUGAGAAAUUCCACCACAA | 486 | UUGUGGUGGAAUUUCUCAU | Rh | [861-879] |
| 28 | 271 | GAAGAAACCUGCAGCCGCA | 487 | UGCGGCUGCAGGUUUCUUC |  | [292-310] |
| 29 | 272 | CUCUCGAGCGCCUUGAAAA | 488 | UUUUCAAGGCGCUCGAGAG |  | [1059-1077] |
| 30 | 273 | GGAACAUGAGCCUUUGUUG | 489 | CAACAAAGGCUCAUGUUCC | Rh | [2109-2127] |
| 31 | 274 | CUCACCUGUGAGACCAAAU | 490 | AUUUGGUCUCACAGGUGAG | Rh | [1810-1828] |
| 32 | 275 | CUACGACGACGAGAAGGAA | 491 | UUCCUUCUCGUCGUCGUAG | Rb | [964-982] |
| 33 | 276 | ACCACAAGAUGGUGGACAA | 492 | UUGUCCACCAUCUUGUGGU | Rh, Rb, M, P | [873-891] |
| 34 | 277 | CUGGCACUGCGGAGAAGUU | 493 | AACUUCUCCGCAGUGCCAG |  | [318-336] |
| 35 | 278 | GGUCCUAUACCGUGGGUGU | 494 | ACACCCACGGUAUAGGACC | Rh | [912-930] |
| 36 | 279 | CCAACCUCUCCCAACUAUA | 495 | UAUAGUUGGGAGAGGUUGG | Rh | [1896-1914] |
| 37 | 280 | GAGAAGGAAAAGCUGCAAA | 496 | UUUGCAGCUUUUCCUUCUC | Rh | [974-992] |
| 38 | 281 | GCCUCUCGAGCGCCUUGAA | 497 | UUCAAGGCGCUCGAGAGGC |  | [1057-1075] |
| 39 | 282 | AGGCCAUUGACAAGAACAA | 498 | UUGUUCUUGUCAAUGGCCU | Rh, D | [1212-1230] |
| 40 | 283 | GACCCAUGACCUGCAGAAA | 499 | UUUCUGCAGGUCAUGGGUC | Rh, Rt, M | [1168-1186] |
| 41 | 284 | CUCCUGGCACUGCGGAGAA | 500 | UUCUCCGCAGUGCCAGGAG |  | [315-333] |
| 42 | 285 | CGGACAGGCCUCUACAACU | 501 | AGUUGUAGAGGCCUGUCCG | Rh, Rb, Rt, P | [944-962] |
| 43 | 286 | GAUGAGAAAUUCCACCACA | 502 | UGUGGUGGAAUUUCUCAUC | Rh | [860-878] |
| 44 | 287 | CACGCAUGUCAGGCAAGAA | 503 | UUCUUGCCUGACAUGCGUG | Rh, D | [1242-1260] |
| 45 | 288 | ACCUCUCCAACUAUAAAA | 504 | UUUUAUAGUUGGGAGAGGU | Rh | [1899-1917] |
| 46 | 289 | ACCAGGCAGUGGAGAACAU | 505 | AUGUUCUCCACUGCCUGGU | Rh | [411-429] |
| 47 | 290 | GGGAACAUGAGCCUUUGUU | 506 | AACAAAGGCUCAUGUUCCC | Rh | [2108-2126] |
| 48 | 291 | AGAAUUCACUCCACUUGGA | 507 | UCCAAGUGGAGUGAAUUCU | Rh | [1653-1671] |
| 49 | 292 | GGGCAGACUCUGGUCAAGA | 508 | UCUUGACCAGAGUCUGCCC | Rh | [2008-2026] |
| 50 | 293 | AGAAGGAAAAGCUGCAAAU | 509 | AUUUGCAGCUUUUCCUUCU | Rh | [975-993] |
| 51 | 294 | GGCAGUGGAGAACAUCCUG | 510 | CAGGAUGUUCUCCACUGCC | Rh | [415-433] |
| 52 | 295 | GGGAUGAGAAAUUCCACCA | 511 | UGGUGGAAUUUCUCAUCCC | Rh | [858-876] |
| 53 | 296 | CCAAGCUGUUCUACGCCGA | 512 | UCGGCGUAGAACAGCUUGG | Rh | [1365-1383] |
| 54 | 297 | ACCGGACAGGCCUCUACAA | 513 | UUGUAGAGGCCUGUCCGGU | Rh, Rb, Rt, P | [942-960] |

TABLE B-continued

Additional Active 19-mer SERPINH1 siRNAs

| No | SEQ ID SEN | Sense siRNA | SEQ ID AS | AntiSense siRNA | Other | human- |
|---|---|---|---|---|---|---|
| 55 | 298 | CUGCCUCAAUCAGUAUUCA | 514 | UGAAUACUGAUUGAGGCAG | | [1771-1789] |
| 56 | 299 | CAGCCCUCUUCUGACACUA | 515 | UAGUGUCAGAAGAGGGCUG | | [1847-1865] |
| 57 | 300 | CCAGCCUCAUCAUCCUCAU | 516 | AUGAGGAUGAUGAGGCUGG | Rh, D, Rt, M | [1023-1041] |
| 58 | 301 | AGGGUGACAAGAUGCGAGA | 517 | UCUCGCAUCUUGUCACCCU | Rh, D | [1458-1476] |
| 59 | 302 | GGACCAGGCAGUGGAGAAC | 518 | GUUCUCCACUGCCUGGUCC | Rh | [409-427] |
| 60 | 303 | GCAGCGCGCUGCAGUCCAU | 519 | AUGGACUGCAGCGCGCUGC | Rh, Rt | [729-747] |
| 61 | 304 | GCGCGCUGCAGUCCAUCAA | 520 | UUGAUGGACUGCAGCGCGC | Rh, Rt | [732-750] |
| 62 | 305 | CCAGAUACCAUGAUGCUGA | 521 | UCAGCAUCAUGGUAUCUGG | Rh | [1680-1698] |
| 63 | 306 | CUAGUGCGGGACACCCAAA | 522 | UUUGGGUGUCCCGCACUAG | | [1400-1418] |
| 64 | 307 | AGGCAGUGGAGAACAUCCU | 523 | AGGAUGUUCUCCACUGCCU | Rh | [414-432] |
| 65 | 308 | CUGAGACACAUGGGUGCUA | 524 | UAGCACCCAUGUGUCUCAG | Rh, D, Rt, M | [1531-1549] |
| 66 | 309 | GAUUGAGAAGGAGCUCCCA | 525 | UGGGAGCUCCUUCUCAAUC | | [1977-1995] |
| 67 | 310 | CGCAGACCACCGACGGCAA | 526 | UUGCCGUCGGUGGUCUGCG | D, Rt | [762-780] |
| 68 | 311 | CCACACUGGGAUGAGAAAU | 527 | AUUUCUCAUCCCAGUGUGG | Rh | [851-869] |
| 69 | 312 | GCUCAGUGAGCUUCGCUGA | 528 | UCAGCGAAGCUCACUGAGC | | [642-660] |
| 70 | 313 | CGCCUUUGAGUUGGACACA | 529 | UGUGUCCAACUCAAAGGCG | Rh | [1294-1312] |
| 71 | 314 | GGGUCAGCCAGCCCUCUUC | 530 | GAAGAGGGCUGGCUGACCC | Rh | [1839-1857] |
| 72 | 315 | GGGCUUCUGGGCAGACUCU | 531 | AGAGUCUGCCCAGAAGCCC | Rh | [2000-2018] |
| 73 | 316 | GGUACCUUCUCACCUGUGA | 532 | UCACAGGUGAGAAGGUACC | Rh | [1802-1820] |
| 74 | 317 | GCCUGCCUCAAUCAGUAUU | 533 | AAUACUGAUUGAGGCAGGC | | [1769-1787] |
| 75 | 318 | UCUACAACUACUACGACGA | 534 | UCGUCGUAGUAGUUGUAGA | Rb | [954-972] |
| 76 | 319 | GGGAAGAUGCAGAAGAAGG | 535 | CCUUCUUCUGCAUCUUCCC | Rh, Rb, Rt | [1112-1130] |
| 77 | 320 | CGAGAAGGAAAAGCUGCAA | 536 | UUGCAGCUUUUCCUUCUCG | Rh | [973-991] |
| 78 | 321 | AGAAGAAGGCUGUUGCCAU | 537 | AUGGCAACAGCCUUCUUCU | Rt | [1122-1140] |
| 79 | 322 | CACAAGCUCUCCAGCCUCA | 538 | UGAGGCUGGAGAGCUUGUG | Rh, D, M, P | [1013-1031] |
| 80 | 323 | GGGUGACAAGAUGCGAGAC | 539 | GUCUCGCAUCUUGUCACCC | Rh, D | [1459-1477] |
| 81 | 324 | UGUUGGAGCGUGGAAAAAA | 540 | UUUUUUCCACGCUCCAACA | | [2190-2208] |
| 82 | 325 | CUUUGAGUUGGACACAGAU | 541 | AUCUGUGUCCAACUCAAAG | Rh | [1297-1315] |
| 83 | 326 | AGCUCUCCAGCCUCAUCAU | 542 | AUGAUGAGGCUGGAGAGCU | Rh, D, Rt, M, | [1017-1035] |
| 84 | 327 | AGCUGUUCUACGCCGACCA | 543 | UGGUCGGCGUAGAACAGCU | Rh | [1368-1386] |
| 85 | 328 | CUGCAGUCCAUCAACGAGU | 544 | ACUCGUUGAUGGACUGCAG | Rh, Rt, M | [737-755] |
| 86 | 329 | UACGACGACGAGAAGGAAA | 545 | UUUCCUUCUCGUCGUCGUA | | [965-983] |
| 87 | 330 | CCUAGUGCGGGACACCCAA | 546 | UUGGGUGUCCCGCACUAGG | | [1399-1417] |
| 88 | 331 | CUUCUCACCUGUGAGACCA | 547 | UGGUCUCACAGGUGAGAAG | Rh | [1807-1825] |
| 89 | 332 | AGUUGGACACAGAUGGCAA | 548 | UUGCCAUCUGUGUCCAACU | | [1302-1320] |
| 90 | 333 | CAGUGGAGAACAUCCUGGU | 549 | ACCAGGAUGUUCUCCACUG | Rh | [417-435] |
| 91 | 334 | CCAGCUAGAAUUCACUCCA | 550 | UGGAGUGAAUUCUAGCUGG | Rh | [1647-1665] |
| 92 | 335 | CGCUGCAGUCCAUCAACGA | 551 | UCGUUGAUGGACUGCAGCG | Rh, Rt | [735-753] |

TABLE B-continued

Additional Active 19-mer SERPINH1 siRNAs

| No | SEQ ID SEN | Sense siRNA | SEQ ID AS | AntiSense siRNA | Other | human- |
|---|---|---|---|---|---|---|
| 93 | 336 | CCAAGGACCAGGCAGUGGA | 552 | UCCACUGCCUGGUCCUUGG | Rh | [405-423] |
| 94 | 337 | AGUUCUUCAAAGAUAGGGA | 553 | UCCCUAUCUUUGAAGAACU | | [2082-2100] |
| 95 | 338 | CGGACCUUCCCAGCUAGAA | 554 | UUCUAGCUGGGAAGGUCCG | Rh | [1638-1656] |
| 96 | 339 | GACAAGAUGCGAGACGAGU | 555 | ACUCGUCUCGCAUCUUGUC | Rh, Rt | [1463-1481] |
| 97 | 340 | CCAAGAUCAACUUCCGCGA | 556 | UCGCGGAAGUUGAUCUUGG | D | [705-723] |
| 98 | 341 | CCCAUCACGUGGAGCCUCU | 557 | AGAGGCUCCACGUGAUGGG | Rh | [1044-1062] |
| 99 | 342 | CCAUGAUGCUGAGCCCGGA | 558 | UCCGGGCUCAGCAUCAUGG | | [1687-1705] |
| 100 | 343 | AGCCUGCCUCAAUCAGUAU | 559 | AUACUGAUUGAGGCAGGCU | | [1768-1786] |
| 101 | 344 | CGGCCUAAGGGUGACAAGA | 560 | UCUUGUCACCCUUAGGCCG | Rh | [1451-1469] |
| 102 | 345 | GGGCCUGACUGAGGCCAUU | 561 | AAUGGCCUCAGUCAGGCCC | Rt | [1201-1219] |
| 103 | 346 | UCACCUGUGAGACCAAAUU | 562 | AAUUUGGUCUCACAGGUGA | Rh | [1811-1829] |
| 104 | 347 | GAGGCCAUUGACAAGAACA | 563 | UGUUCUUGUCAAUGGCCUC | Rh, D | [1211-1229] |
| 105 | 348 | GCUCCUGGCACUGCGGAGA | 564 | UCUCCGCAGUGCCAGGAGC | | [314-332] |
| 106 | 349 | GGCGCCUGGUCCGGCCUAA | 565 | UUAGGCCGGACCAGGCGCC | Rh | [1440-1458] |
| 107 | 350 | CCAGCCCUCUUCUGACACU | 566 | AGUGUCAGAAGAGGGCUGG | | [1846-1864] |
| 108 | 351 | ACUACGACGACGAGAAGGA | 567 | UCCUUCUCGUCGUCGUAGU | Rb | [963-981] |
| 109 | 352 | CCUAUACCGUGGGUGUCAU | 568 | AUGACACCCACGGUAUAGG | Rh, D, P | [915-933] |
| 110 | 353 | GACCCAGCUCAGUGAGCUU | 569 | AAGCUCACUGAGCUGGGUC | | [636-654] |
| 111 | 354 | UGGGUGUCAUGAUGAUGCA | 570 | UGCAUCAUCAUGACACCCA | Rh | [924-942] |
| 112 | 355 | CCAAGGGUGUGGUGGAGGU | 571 | ACCUCCACCACACCCUUGG | Rh, D | [1149-1167] |
| 113 | 356 | AGGUCACCAAGGACGUGGA | 572 | UCCACGUCCUUGGUGACCU | Rh, D | [789-807] |
| 114 | 357 | CCCUGGCCGCCGAGGUGAA | 573 | UUCACCUCGGCGGCCAGGG | | [276-294] |
| 115 | 358 | AGCACUCCAAGAUCAACUU | 574 | AAGUUGAUCUUGGAGUGCU | Rh, D | [699-717] |
| 116 | 359 | CCUGGCACUGCGGAGAAGU | 575 | ACUUCUCCGCAGUGCCAGG | | [317-335] |
| 117 | 360 | GAUGCAGAAGAAGGCUGUU | 576 | AACAGCCUUCUUCUGCAUC | Rh, Rt, M | [1117-1135] |
| 118 | 361 | CCCACAAGCUCUCCAGCCU | 577 | AGGCUGGAGAGCUUGUGGG | Rh, D, P | [1011-1029] |
| 119 | 362 | CUCUUCUGACACUAAAACA | 578 | UGUUUUAGUGUCAGAAGAG | | [1852-1870] |
| 120 | 363 | ACGAGAAGGAAAAGCUGCA | 579 | UGCAGCUUUUCCUUCUCGU | Rh | [972-990] |
| 121 | 364 | UGAAAAGCUGCUAACCAAA | 580 | UUUGGUUAGCAGCUUUUCA | | [1072-1090] |
| 122 | 365 | UCUCACCUGUGAGACCAAA | 581 | UUUGGUCUCACAGGUGAGA | Rh | [1809-1827] |
| 123 | 366 | CAUGAUGAUGCACCGGACA | 582 | UGUCCGGUGCAUCAUCAUG | Rh | [931-949] |
| 124 | 367 | GGAUUGAGAAGGAGCUCCC | 583 | GGGAGCUCCUUCUCAAUCC | | [1976-1994] |
| 125 | 368 | CCUUCAUCUUCCUAGUGCG | 584 | CGCACUAGGAAGAUGAAGG | | [1389-1407] |
| 126 | 369 | GGCCUGGCCUUCAGCUUGU | 585 | ACAAGCUGAAGGCCAGGCC | | [374-392] |
| 127 | 370 | GGUCAGCCAGCCCUCUUCU | 586 | AGAAGAGGGCUGGCUGACC | Rh | [1840-1858] |
| 128 | 371 | UUCUCACCUGUGAGACCAA | 587 | UUGGUCUCACAGGUGAGAA | Rh | [1808-1826] |
| 129 | 372 | CGCAGCAGCUCCUGGCACU | 588 | AGUGCCAGGAGCUGCUGCG | | [307-325] |
| 130 | 373 | GCCAUGUUCUUCAAGCCAC | 589 | GUGGCUUGAAGAACAUGGC | Rh, Rb, D | [836-854] |

TABLE B-continued

Additional Active 19-mer SERPINH1 siRNAs

| No  | SEQ ID SEN | Sense siRNA         | SEQ ID AS | AntiSense siRNA     | Other       | human-      |
|-----|------------|---------------------|-----------|---------------------|-------------|-------------|
| 131 | 374        | AGGCAGUGCUGAGCGCCGA | 590       | UCGGCGCUCAGCACUGCCU |             | [510-528]   |
| 132 | 375        | CACCUGUGAGACCAAAUUG | 591       | CAAUUUGGUCUCACAGGUG | Rh          | [1812-1830] |
| 133 | 376        | CACCGGACAGGCCUCUACA | 592       | UGUAGAGGCCUGUCCGGUG | Rh, Rb, Rt, P | [941-959] |
| 134 | 377        | AGCUAGAAUUCACUCCACU | 593       | AGUGGAGUGAAUUCUAGCU | Rh          | [1649-1667] |
| 135 | 378        | AGAUGCAGAAGAAGGCUGU | 594       | ACAGCCUUCUUCUGCAUCU | Rh, Rt, M   | [1116-1134] |
| 136 | 379        | CCCUGCUAGUCAACGCCAU | 595       | AUGGCGUUGACUAGCAGGG | Rh          | [822-840]   |
| 137 | 380        | ACAACUACUACGACGACGA | 596       | UCGUCGUCGUAGUAGUUGU | Rb          | [957-975]   |
| 138 | 381        | GCUCCUGAGACACAUGGGU | 597       | ACCCAUGUGUCUCAGGAGC | D           | [1527-1545] |
| 139 | 382        | UGGAGAACAUCCUGGUGUC | 598       | GACACCAGGAUGUUCUCCA | Rh          | [420-438]   |
| 140 | 383        | AGCGCGCUGCAGUCCAUCA | 599       | UGAUGGACUGCAGCGCGCU | Rh, Rt      | [731-749]   |
| 141 | 384        | CGCCUUGAAAAGCUGCUAA | 600       | UUAGCAGCUUUUCAAGGCG |             | [1067-1085] |
| 142 | 385        | GCCUUUGUUGCUAUCAAUC | 601       | GAUUGAUAGCAACAAAGGC | Rh          | [2118-2136] |
| 143 | 386        | CUCUACAACUACUACGACG | 602       | CGUCGUAGUAGUUGUAGAG | Rb          | [953-971]   |
| 144 | 387        | CGCUCACUCAGCAACUCCA | 603       | UGGAGUUGCUGAGUGAGCG | Rh          | [575-593]   |
| 145 | 388        | GGUACCAGCCUUGGAUACU | 604       | AGUAUCCAAGGCUGGUACC | Rh          | [1571-1589] |
| 146 | 389        | GCCUGACUGAGGCCAUUGA | 605       | UCAAUGGCCUCAGUCAGGC | Rh          | [1203-1221] |
| 147 | 390        | UGAGCUUCGCUGAUGACUU | 606       | AAGUCAUCAGCGAAGCUCA | Rh          | [648-666]   |
| 148 | 391        | CCAGCCUUGGAUACUCCAU | 607       | AUGGAGUAUCCAAGGCUGG | Rh          | [1575-1593] |
| 149 | 392        | AAAGGCUCCUGAGACACAU | 608       | AUGUGUCUCAGGAGCCUUU |             | [1523-1541] |
| 150 | 393        | UGACCCAUGACCUGCAGAA | 609       | UUCUGCAGGUCAUGGGUCA | Rh, Rt, M   | [1167-1185] |
| 151 | 394        | CCUGUGAGACCAAAUUGAG | 610       | CUCAAUUUGGUCUCACAGG | Rh          | [1814-1832] |
| 152 | 395        | GCGGACCUUCCCAGCUAGA | 611       | UCUAGCUGGGAAGGUCCGC | Rh          | [1637-1655] |
| 153 | 396        | GGAAGAUGCAGAAGAAGGC | 612       | GCCUUCUUCUGCAUCUUCC | Rh, Rb, Rt  | [1113-1131] |
| 154 | 397        | UGCCCAAGGGUGUGGUGGA | 613       | UCCACCACACCCUUGGGCA | Rh, D       | [1146-1164] |
| 155 | 398        | GGAGCCUCUCGAGCGCCUU | 614       | AAGGCGCUCGAGAGGCUCC |             | [1054-1072] |
| 156 | 399        | GACUCUGGUCAAGAAGCAU | 615       | AUGCUUCUUGACCAGAGUC | Rh          | [2013-2031] |
| 157 | 400        | CAGGCAGUGGAGAACAUCC | 616       | GGAUGUUCUCCACUGCCUG | Rh          | [413-431]   |
| 158 | 401        | CAAGCCUGCUCAAUCAGU  | 617       | ACUGAUUGAGGCAGGCUUG | Rh          | [1766-1784] |
| 159 | 402        | CUGGAAGCUGGGCAGCCGA | 618       | UCGGCUGCCCAGCUUCCAG |             | [610-628]   |
| 160 | 403        | GAAGAAGGCUGUUGCCAUC | 619       | GAUGGCAACAGCCUUCUUC | Rt          | [1123-1141] |
| 161 | 404        | GGGCGAGCUGCUGCGCUCA | 620       | UGAGCGCAGCAGCUCGCCC | Rh          | [562-580]   |
| 162 | 405        | AAGCCACACUGGGAUGAGA | 621       | UCUCAUCCCAGUGUGGCUU | Rh, Rb, M   | [848-866]   |
| 163 | 406        | GUGUGGUGGAGGUGACCCA | 622       | UGGGUCACCUCCACCACAC | Rh, D       | [1155-1173] |
| 164 | 407        | CCGCCUUUGAGUUGGACAC | 623       | GUGUCCAACUCAAAGGCGG | Rh          | [1293-1311] |
| 165 | 408        | GGCCAUUGACAAGAACAAG | 624       | CUUGUUCUUGUCAAUGGCC | Rh, D       | [1213-1231] |
| 166 | 409        | UGCCUCAAUCAGUAUUCAU | 625       | AUGAAUACUGAUUGAGGCA |             | [1772-1790] |
| 167 | 410        | CCUUCCCAGCUAGAAUUCA | 626       | UGAAUUCUAGCUGGGAAGG | Rh          | [1642-1660] |
| 168 | 411        | GGGACCUGGGCCAUAGUCA | 627       | UGACUAUGGCCCAGGUCCC |             | [1721-1739] |

TABLE B-continued

Additional Active 19-mer SERPINH1 siRNAs

| No | SEQ ID SEN | Sense siRNA | SEQ ID AS | AntiSense siRNA | Other | human- |
|---|---|---|---|---|---|---|
| 169 | 412 | CGAGGUGAAGAAACCUGCA | 628 | UGCAGGUUUCUUCACCUCG | Rh | [286-304] |
| 170 | 413 | GCCUUUGAGUUGGACACAG | 629 | CUGUGUCCAACUCAAAGGC | Rh | [1295-1313] |
| 171 | 414 | AGCGGACCUUCCCAGCUAG | 630 | CUAGCUGGGAAGGUCCGCU | Rh | [1636-1654] |
| 172 | 415 | CGCAUGUCAGGCAAGAAGG | 631 | CCUUCUUGCCUGACAUGCG | Rh, D | [1244-1262] |
| 173 | 416 | ACAACUGCGAGCACUCCAA | 632 | UUGGAGUGCUCGCAGUUGU | Rh, D | [690-708] |
| 174 | 417 | GAGGCGGAUUGAGAAGGAG | 633 | CUCCUUCUCAAUCCGCCUC | | [1971-1989] |
| 175 | 418 | GGCCGCCGAGGUGAAGAAA | 634 | UUUCUUCACCUCGGCGGCC | | [280-298] |
| 176 | 419 | CAGCUCUAUCCCAACCUCU | 635 | AGAGGUUGGGAUAGAGCUG | | [1886-1904] |
| 177 | 420 | AGCUGGGCAGCCGACUGUA | 636 | UACAGUCGGCUGCCCAGCU | | [615-633] |
| 178 | 421 | GCCAUUGACAAGAACAAGG | 637 | CCUUGUUCUUGUCAAUGGC | Rh, D | [1214-1232] |
| 179 | 422 | CGCCAUGUUCUUCAAGCCA | 638 | UGGCUUGAAGAACAUGGCG | Rh, Rb, P | [835-853] |
| 180 | 423 | CCGAGGUCACCAAGGACGU | 639 | ACGUCCUUGGUGACCUCGG | Rh, D | [786-804] |
| 181 | 424 | GGACCCAGCUCAGUGAGCU | 640 | AGCUCACUGAGCUGGGUCC | | [635-653] |
| 182 | 425 | CCAAUGACAUUUUGUUGGA | 641 | UCCAACAAAAUGUCAUUGG | | [2178-2196] |
| 183 | 426 | AGUGAGGCGGAUUGAGAAG | 642 | CUUCUCAAUCCGCCUCACU | | [1968-1986] |
| 184 | 427 | UGCAGUCCAUCAACGAGUG | 643 | CACUCGUUGAUGGACUGCA | Rh, Rt, M | [738-756] |
| 185 | 428 | UGUCACGCAUGUCAGGCAA | 644 | UUGCCUGACAUGCGUGACA | Rh, D | [1239-1257] |
| 186 | 429 | CGACGACGAGAAGGAAAAG | 645 | CUUUUCCUUCUCGUCGUCG | | [967-985] |
| 187 | 430 | ACAAGAACAAGGCCGACUU | 646 | AAGUCGGCCUUGUUCUUGU | Rh | [1221-1239] |
| 188 | 431 | CUUCAAGCCACACUGGGAU | 647 | AUCCCAGUGUGGCUUGAAG | Rh, Rb, D | [844-862] |
| 189 | 432 | CCUGGGCCAUAGUCAUUCU | 648 | AGAAUGACUAUGGCCCAGG | | [1725-1743] |
| 190 | 433 | UUUGUUGGAGCGUGGAAAA | 649 | UUUUCCACGCUCCAACAAA | | [2188-2206] |
| 191 | 434 | AGAACAUCCUGGUGUCACC | 650 | GGUGACACCAGGAUGUUCU | | [423-441] |
| 192 | 435 | ACGCCACCGCCUUUGAGUU | 651 | AACUCAAAGGCGGUGGCGU | Rh | [1287-1305] |
| 193 | 436 | GUGAGGUACCAGCCUUGGA | 652 | UCCAAGGCUGGUACCUCAC | Rh | [1567-1585] |
| 194 | 437 | GCGCCUUCUGCCUCCUGGA | 653 | UCCAGGAGGCAGAAGGCGC | | [252-270] |
| 195 | 438 | GCCUGGCCUUCAGCUUGUA | 654 | UACAAGCUGAAGGCCAGGC | | [375-393] |
| 196 | 439 | CCCGGAAACUCCACAUCCU | 655 | AGGAUGUGGAGUUUCCGGG | | [1700-1718] |
| 197 | 440 | UCUUCAAGCCACACUGGGA | 656 | UCCCAGUGUGGCUUGAAGA | Rh, Rb, D | [843-861] |
| 198 | 441 | UGUUGCUAUCAAUCCAAGA | 657 | UCUUGGAUUGAUAGCAACA | Rh | [2123-2141] |
| 199 | 442 | GAGUGGGCCGCGCAGACCA | 658 | UGGUCUGCGCGGCCCACUC | | [752-770] |
| 200 | 443 | CCUGAGACACAUGGGUGCU | 659 | AGCACCCAUGUGUCUCAGG | D, Rt, M | [1530-1548] |
| 201 | 444 | AGCCGACUGUACGGACCCA | 660 | UGGGUCCGUACAGUCGGCU | | [623-641] |
| 202 | 445 | GGGCCUCAGGGUGCACACA | 661 | UGUGUGCACCCUGAGGCCC | | [1486-1504] |
| 203 | 446 | ACUGGGAUGAGAAAUUCCA | 662 | UGGAAUUUCUCAUCCCAGU | Rh | [855-873] |
| 204 | 447 | AGAAUGACCUGGCCGCAGU | 663 | ACUGCGGCCAGGUCAUUCU | | [1952-1970] |
| 205 | 448 | CAUAUUUAUAGCCAGGUAC | 664 | GUACCUGGCUAUAAAUAUG | Rh | [1788-1806] |
| 206 | 449 | AGGUGACCCAUGACCUGCA | 665 | UGCAGGUCAUGGGUCACCU | Rh, Rt, M | [1164-1182] |

TABLE B-continued

Additional Active 19-mer SERPINH1 siRNAs

| No | SEQ ID SEN | Sense siRNA | SEQ ID AS | AntiSense siRNA | Other | human- |
|---|---|---|---|---|---|---|
| 207 | 450 | GCGCUGCAGUCCAUCAACG | 666 | CGUUGAUGGACUGCAGCGC | Rh, Rt | [734-752] |
| 208 | 451 | GGUGACAAGAUGCGAGACG | 667 | CGUCUCGCAUCUUGUCACC | Rh | [1460-1478] |
| 209 | 452 | CUUCAAAGAUAGGGAGGGA | 668 | UCCCUCCCUAUCUUUGAAG | | [2086-2104] |
| 210 | 453 | AGCUGCAAAUCGUGGAGAU | 669 | AUCUCCACGAUUUGCAGCU | Rh | [984-1002] |
| 211 | 454 | GUGGAGAACAUCCUGGUGU | 670 | ACACCAGGAUGUUCUCCAC | Rh | [419-437] |
| 212 | 455 | GAACAAGGCCGACUUGUCA | 671 | UGACAAGUCGGCCUUGUUC | Rh | [1225-1243] |
| 213 | 456 | CAUGAUGCUGAGCCCGGAA | 672 | UUCCGGGCUCAGCAUCAUG | | [1688-1706] |
| 214 | 457 | GCGCCUUGAAAAGCUGCUA | 673 | UAGCAGCUUUUCAAGGCGC | Rh | [1066-1084] |
| 215 | 458 | GCAGACUCUGGUCAAGAAG | 674 | CUUCUUGACCAGAGUCUGC | Rh | [2010-2028] |
| 216 | 459 | CCAGGCAGUGGAGAACAUC | 675 | GAUGUUCUCCACUGCCUGG | Rh | [412-430] |

TABLE C

Cross-Species 19-mer SERPINH1 siRNAs

| No. | SEQ ID SEN | Sense siRNA | SEQ ID AS | AntiSense siRNA | Other Species | human- |
|---|---|---|---|---|---|---|
| 1 | 676 | CACUACAACUGCGAGCACU | 973 | AGUGCUCGCAGUUGUAGUG | Rh, D | [686-704] |
| 2 | 677 | AACCGUGGCUUCAUGGUGA | 974 | UCACCAUGAAGCCACGGUU | Rh, Rt, M | [890-908] |
| 3 | 678 | GGCAAGAAGGACCUGUACC | 975 | GGUACAGGUCCUUCUUGCC | Rh, D, M | [1253- |
| 4 | 679 | GGUGGACAACCGUGGCUUC | 976 | GAAGCCACGGUUGUCCACC | Rh, M | [883-901] |
| 5 | 680 | AGGCCAUGGCCAAGGACCA | 977 | UGGUCCUUGGCCAUGGCCU | Rh, D | [396-414] |
| 6 | 681 | CGCAGCGCGCUGCAGUCCA | 978 | UGGACUGCAGCGCGCUGCG | Rh, Rt | [728-746] |
| 7 | 682 | AGCAGCAAGCAGCACUACA | 979 | UGUAGUGCUGCUUGCUGCU | Rh, D | [674-692] |
| 8 | 683 | GGCCUCUACAACUACUACG | 980 | CGUAGUAGUUGUAGAGGCC | Rb, D | [950-968] |
| 9 | 684 | GAAGAUGCAGAAGAAGGCU | 981 | AGCCUUCUUCUGCAUCUUC | Rh, Rb, Rt | [1114- |
| 10 | 685 | GGCUCCUGAGACACAUGGG | 982 | CCCAUGUGUCUCAGGAGCC | D | [1526- |
| 11 | 686 | AGCAAGCAGCACUACAACU | 983 | AGUUGUAGUGCUGCUUGCU | Rh, D | [677-695] |
| 12 | 687 | GGAGGUGACCCAUGACCUG | 984 | CAGGUCAUGGGUCACCUCC | Rh, Rt, M | [1162- |
| 13 | 688 | CCCUUUGACCAGGACAUCU | 985 | AGAUGUCCUGGUCAAAGGG | Rh, Rt | [1322- |
| 14 | 689 | CUCCUGAGACACAUGGGUG | 986 | CACCCAUGUGUCUCAGGAG | D | [1528- |
| 15 | 690 | AAGGCUCCUGAGACACAUG | 987 | CAUGUGUCUCAGGAGCCUU | D | [1524- |
| 16 | 691 | CGCGCUGCAGUCCAUCAAC | 988 | GUUGAUGGACUGCAGCGCG | Rh, Rt | [733-751] |
| 17 | 692 | AGGGUGUGGUGGAGGUGAC | 989 | GUCACCUCCACCACACCCU | Rh, D | [1152- |
| 18 | 693 | AGCACUACAACUGCGAGCA | 990 | UGCUCGCAGUUGUAGUGCU | Rh, D | [684-702] |
| 19 | 694 | GGCUCCCUGCUAUUCAUUG | 991 | CAAUGAAUAGCAGGGAGCC | D | [1421- |
| 20 | 695 | GCGCAACGUGACCUGGA | 992 | UCCAGGUCACGUUGCGCGC | M | [596-614] |
| 21 | 696 | GCUGCAGUCCAUCAACGAG | 993 | CUCGUUGAUGGACUGCAGC | Rh, Rt | [736-754] |
| 22 | 697 | ACCAAAGAGCAGCUGAAGA | 994 | UCUUCAGCUGCUCUUUGGU | Rh, Rb, P | [1085- |
| 23 | 698 | CCAAGGACGUGGAGCGCAC | 995 | GUGCGCUCCACGUCCUUGG | Rh, D | [795-813] |
| 24 | 699 | UGUUCUUCAAGCCACACUG | 996 | CAGUGUGGCUUGAAGAACA | Rh, Rb, D | [840-858] |

TABLE C-continued

Cross-Species 19-mer SERPINH1 siRNAs

| No. | SEQ ID SEN | Sense siRNA | SEQ ID AS | AntiSense siRNA | Other Species | human- |
|---|---|---|---|---|---|---|
| 25 | 700 | GCCCAAGGGUGUGGUGGAG | 997 | CUCCACCACACCCUUGGGC | Rh, D | [1147- |
| 26 | 701 | ACAGGCCUCUACAACUACU | 998 | AGUAGUUGUAGAGGCCUGU | Rh, Rb, D, Rt, P | [947-965] |
| 27 | 702 | UGCGCAGCAGCAAGCAGCA | 999 | UGCUGCUUGCUGCUGCGCA | Rh, D | [669-687] |
| 28 | 703 | GGUGGAGGUGACCCAUGAC | 1000 | GUCAUGGGUCACCUCCACC | Rh, Rt, M | [1159- |
| 29 | 704 | CUUUGACCAGGACAUCUAC | 1001 | GUAGAUGUCCUGGUCAAAG | Rh, Rt | [1324- |
| 30 | 705 | AAGGGUGUGGUGGAGGUGA | 1002 | UCACCUCCACCACACCCUU | Rh, D | [1151- |
| 31 | 706 | UCCUAUACCGUGGGUGUCA | 1003 | UGACACCCACGGUAUAGGA | Rh, D, P | [914-932] |
| 32 | 707 | GCGCAGACCACCGACGGCA | 1004 | UGCCGUCGGUGGUCUGCGC | D | [761-779] |
| 33 | 708 | CGCAGCAGCAAGCAGCACU | 1005 | AGUGCUGCUUGCUGCUGCG | Rh, D | [671-689] |
| 34 | 709 | GCCUCAUCAUCCUCAUGCC | 1006 | GGCAUGAGGAUGAUGAGGC | Rh, D, Rt, M | [1026- |
| 35 | 710 | UCUCCAGCCUCAUCAUCCU | 1007 | AGGAUGAUGAGGCUGGAGA | Rh, D, Rt, M | [1020- |
| 36 | 711 | CCAUUGACAAGAACAAGGC | 1008 | GCCUUGUUCUUGUCAAUGG | Rh, D | [1215- |
| 37 | 712 | AGCAGCACUACAACUGCGA | 1009 | UCGCAGUUGUAGUGCUGCU | Rh, D | [681-699] |
| 38 | 713 | UGCACCGGACAGGCCUCUA | 1010 | UAGAGGCCUGUCCGGUGCA | Rh, Rb, Rt, P | [939-957] |
| 39 | 714 | ACUCCAAGAUCAACUUCCG | 1011 | CGGAAGUUGAUCUUGGAGU | Rh, D, Rt, M | [702-720] |
| 40 | 715 | UGGACAACCGUGGCUUCAU | 1012 | AUGAAGCCACGGUUGUCCA | Rh, M | [885-903] |
| 41 | 716 | GAGCAGCUGAAGAUCUGGA | 1013 | UCCAGAUCUUCAGCUGCUC | Rh, D | [1091- |
| 42 | 717 | CAGAAGAAGGCUGUUGCCA | 1014 | UGGCAACAGCCUUCUUCUG | Rt | [1121- |
| 43 | 718 | AGGCAAGAAGGACCUGUAC | 1015 | GUACAGGUCCUUCUUGCCU | Rh, D | [1252- |
| 44 | 719 | CCUCUACAACUACUACGAC | 1016 | GUCGUAGUAGUUGUAGAGG | Rb, D | [952-970] |
| 45 | 720 | AGCAGCUGAAGAUCUGGAU | 1017 | AUCCAGAUCUUCAGCUGCU | Rh, D | [1092- |
| 46 | 721 | AACUACUACGACGACGAGA | 1018 | UCUCGUCGUCGUAGUAGUU | Rb | [959-977] |
| 47 | 722 | GGCAAGCUGCCCGAGGUCA | 1019 | UGACCUCGGGCAGCUUGCC | Rh, D | [776-794] |
| 48 | 723 | CCGGACAGGCCUCUACAAC | 1020 | GUUGUAGAGGCCUGUCCGG | Rh, Rb, Rt, P | [943-961] |
| 49 | 724 | GCUCCCUGCUAUUCAUUGG | 1021 | CCAAUGAAUAGCAGGGAGC | D | [1422- |
| 50 | 725 | AACUGCGAGCACUCCAAGA | 1022 | UCUUGGAGUGCUCGCAGUU | Rh, D | [692-710] |
| 51 | 726 | GACACAUGGGUGCUAUUGG | 1023 | CCAAUAGCACCCAUGUGUC | Rh, Rt, M | [1535- |
| 52 | 727 | GCACCGGACAGGCCUCUAC | 1024 | GUAGAGGCCUGUCCGGUGC | Rh, Rb, Rt, P | [940-958] |
| 53 | 728 | AGCGCAGCGCGCUGCAGUC | 1025 | GACUGCAGCGCGCUGCGCU | Rh, Rt | [726-744] |
| 54 | 729 | GGACGUGGAGCGCACGGAC | 1026 | GUCCGUGCGCUCCACGUCC | Rh, D | [799-817] |
| 55 | 730 | CAGCCUCAUCAUCCUCAUG | 1027 | CAUGAGGAUGAUGAGGCUG | Rh, D, Rt, M | [1024- |
| 56 | 731 | AAGAUCAACUUCCGCGACA | 1028 | UGUCGCGGAAGUUGAUCUU | D | [707-725] |
| 57 | 732 | GCGCAACGUGACCUGGAAG | 1029 | CUUCCAGGUCACGUUGCGC | M | [598-616] |
| 58 | 733 | ACUGCGAGCACUCCAAGAU | 1030 | AUCUUGGAGUGCUCGCAGU | Rh, D | [693-711] |
| 59 | 734 | GUGGACAACCGUGGCUUCA | 1031 | UGAAGCCACGGUUGUCCAC | Rh, M | [884-902] |
| 60 | 735 | CCACAAGCUCUCCAGCCUC | 1032 | GAGGCUGGAGAGCUUGUGG | Rh, D, P | [1012- |
| 61 | 736 | CAAGAUGGUGGACAACCGU | 1033 | ACGGUUGUCCACCAUCUUG | Rh, Rb, M, P | [877-895] |
| 62 | 737 | CGAGCACUCCAAGAUCAAC | 1034 | GUUGAUCUUGGAGUGCUCG | Rh, D | [697-715] |

TABLE C-continued

Cross-Species 19-mer SERPINH1 siRNAs

| No. | SEQ ID SEN | Sense siRNA | SEQ ID AS | AntiSense siRNA | Other Species | human- |
|---|---|---|---|---|---|---|
| 63 | 738 | AGCUGCCCGAGGUCACCAA | 1035 | UUGGUGACCUCGGGCAGCU | Rh, D | [780-798] |
| 64 | 739 | GGACAUCUACGGGCGCGAG | 1036 | CUCGCGCCCGUAGAUGUCC | D | [1333- |
| 65 | 740 | AGGACAUCUACGGGCGCGA | 1037 | UCGCGCCCGUAGAUGUCCU | D | [1332- |
| 66 | 741 | UGUCAGGCAAGAAGGACCU | 1038 | AGGUCCUUCUUGCCUGACA | Rh, D | [1248- |
| 67 | 742 | GGGUGUGGUGGAGGUGACC | 1039 | GGUCACCUCCACCACACCC | Rh, D | [1153- |
| 68 | 743 | CAAGCUCUCCAGCCUCAUC | 1040 | GAUGAGGCUGGAGAGCUUG | Rh, D, M, P | [1015- |
| 69 | 744 | GUGACCCAUGACCUGCAGA | 1041 | UCUGCAGGUCAUGGGUCAC | Rh, Rt, M | [1166- |
| 70 | 745 | GUUCUUCAAGCCACACUGG | 1042 | CCAGUGUGGCUUGAAGAAC | Rh, Rb, D | [841-859] |
| 71 | 746 | ACAUCUACGGGCGCGAGGA | 1043 | UCCUCGCGCCCGUAGAUGU | D, M | [1335- |
| 72 | 747 | UGGAGGUGACCCAUGACCU | 1044 | AGGUCAUGGGUCACCUCCA | Rh, Rt, M | [1161- |
| 73 | 748 | UGCAGAAGAAGGCUGUUGC | 1045 | GCAACAGCCUUCUUCUGCA | Rt | [1119- |
| 74 | 749 | UGUACCAGGCCAUGGCCAA | 1046 | UUGGCCAUGGCCUGGUACA | Rh, D | [390-408] |
| 75 | 750 | UGUGGUGGAGGUGACCCAU | 1047 | AUGGGUCACCUCCACCACA | Rh, D | [1156- |
| 76 | 751 | AGAAGGACCUGUACCUGGC | 1048 | GCCAGGUACAGGUCCUUCU | Rh, D | [1257- |
| 77 | 752 | AGCAGCUGCGCGACGAGGA | 1049 | UCCUCGUCGCGCAGCUGCU | Rh, D | [528-546] |
| 78 | 753 | ACGCCAUGUUCUUCAAGCC | 1050 | GGCUUGAAGAACAUGGCGU | Rh, Rb, P | [834-852] |
| 79 | 754 | ACAAGAUGGUGGACAACCG | 1051 | CGGUUGUCCACCAUCUUGU | Rh, Rb, M, P | [876-894] |
| 80 | 755 | CUGCGAGCACUCCAAGAUC | 1052 | GAUCUUGGAGUGCUCGCAG | Rh, D | [694-712] |
| 81 | 756 | GUCACGCAUGUCAGGCAAG | 1053 | CUUGCCUGACAUGCGUGAC | Rh, D | [1240- |
| 82 | 757 | ACGCAUGUCAGGCAAGAAG | 1054 | CUUCUUGCCUGACAUGCGU | Rh, D | [1243- |
| 83 | 758 | UGCUAUUCAUUGGGCGCCU | 1055 | AGGCGCCCAAUGAAUAGCA | D | [1428- |
| 84 | 759 | UGCGCGACGAGGAGGUGCA | 1056 | UGCACCUCCUCGUCGCGCA | Rh, D | [534-552] |
| 85 | 760 | GCAGCUGAAGAUCUGGAUG | 1057 | CAUCCAGAUCUUCAGCUGC | Rh, D | [1093- |
| 86 | 761 | CCAUGACCUGCAGAAACAC | 1058 | GUGUUUCUGCAGGUCAUGG | Rh, Rt, M | [1171- |
| 87 | 762 | AAGCUCUCCAGCCUCAUCA | 1059 | UGAUGAGGCUGGAGAGCUU | Rh, D, Rt, M, P | [1016- |
| 88 | 763 | CAGCAAGCAGCACUACAAC | 1060 | GUUGUAGUGCUGCUUGCUG | Rh, D | [676-694] |
| 89 | 764 | AUGUUCUUCAAGCCACACU | 1061 | AGUGUGGCUUGAAGAACAU | Rh, Rb, D | [839-857] |
| 90 | 765 | UCCUGAGACACAUGGGUGC | 1062 | GCACCCAUGUGUCUCAGGA | D, Rt, M | [1529- |
| 91 | 766 | CACUCCAAGAUCAACUUCC | 1063 | GGAAGUUGAUCUUGGAGUG | Rh, D, Rt, M | [701-719] |
| 92 | 767 | AAGGGUGACAAGAUGCGAG | 1064 | CUCGCAUCUUGUCACCCUU | Rh, D | [1457- |
| 93 | 768 | GACAGGCCUCUACAACUAC | 1065 | GUAGUUGUAGAGGCCUGUC | Rh, Rb, Rt, P | [946-964] |
| 94 | 769 | ACCCAUGACCUGCAGAAAC | 1066 | GUUUCUGCAGGUCAUGGGU | Rh, Rt, M | [1169- |
| 95 | 770 | CACCACAAGAUGGUGGACA | 1067 | UGUCCACCAUCUUGUGGUG | Rh, Rb, M, P | [872-890] |
| 96 | 771 | GCAGAAGAAGGCUGUUGCC | 1068 | GGCAACAGCCUUCUUCUGC | Rt | [1120- |
| 97 | 772 | GUGGUGGAGGUGACCCAUG | 1069 | CAUGGGUCACCUCCACCAC | Rh, Rb, Rt, M | [1157- |
| 98 | 773 | AGGCCUCUACAACUACUAC | 1070 | GUAGUAGUUGUAGAGGCCU | Rh, Rb, D, Rt, P | [949-967] |
| 99 | 774 | GGUGACCCAUGACCUGCAG | 1071 | CUGCAGGUCAUGGGUCACC | Rh, Rt, M | [1165- |
| 100 | 775 | GCCGAGGUGAAGAAACCUG | 1072 | CAGGUUUCUUCACCUCGGC | Rh, Rt | [284-302] |

TABLE C-continued

Cross-Species 19-mer SERPINH1 siRNAs

| No. | SEQ ID SEN | Sense siRNA | SEQ ID AS | AntiSense siRNA | Other Species | human- |
|---|---|---|---|---|---|---|
| 101 | 776 | CAACUACUACGACGACGAG | 1073 | CUCGUCGUCGUAGUAGUUG | Rb | [958-976] |
| 102 | 777 | CAAGAAGGACCUGUACCUG | 1074 | CAGGUACAGGUCCUUCUUG | Rh, D, M | [1255- |
| 103 | 778 | UGUUCCACGCCACCGCCUU | 1075 | AAGGCGGUGGCGUGGAACA | D | [1281- |
| 104 | 779 | CCCUGCUAUUCAUUGGGCG | 1076 | CGCCCAAUGAAUAGCAGGG | D | [1425- |
| 105 | 780 | CCGUGGCUUCAUGGUGACU | 1077 | AGUCACCAUGAAGCCACGG | Rh, Rt, M | [892-910] |
| 106 | 781 | CUACAACUACUACGACGAC | 1078 | GUCGUCGUAGUAGUUGUAG | Rb | [955-973] |
| 107 | 782 | GCAGCACUACAACUGCGAG | 1079 | CUCGCAGUUGUAGUGCUGC | Rh, D | [682-700] |
| 108 | 783 | UGGUGGACAACCGUGGCUU | 1080 | AAGCCACGGUUGUCCACCA | Rh, M | [882-900] |
| 109 | 784 | AGACCACCGACGGCAAGCU | 1081 | AGCUUGCCGUCGGUGGUCU | D, Rt | [765-783] |
| 110 | 785 | AGAAACACCUGGCUGGGCU | 1082 | AGCCCAGCCAGGUGUUUCU | D | [1182- |
| 111 | 786 | ACCAAGGACGUGGAGCGCA | 1083 | UGCGCUCCACGUCCUUGGU | Rh, D | [794-812] |
| 112 | 787 | CCGAGGUGAAGAAACCUGC | 1084 | GCAGGUUUCUUCACCUCGG | Rh, Rt | [285-303] |
| 113 | 788 | ACUACAACUGCGAGCACUC | 1085 | GAGUGCUCGCAGUUGUAGU | Rh, D | [687-705] |
| 114 | 789 | ACAAGCUCUCCAGCCUCAU | 1086 | AUGAGGCUGGAGAGCUUGU | Rh, D, M, P | [1014- |
| 115 | 790 | AGGACGUGGAGCGCACGGA | 1087 | UCCGUGCGCUCCACGUCCU | Rh, D | [798-816] |
| 116 | 791 | GCUAUUCAUUGGGCGCCUG | 1088 | CAGGCGCCCAAUGAAUAGC | D | [1429- |
| 117 | 792 | AACUUCCGCGACAAGCGCA | 1089 | UGCGCUUGUCGCGGAAGUU | D | [713-731] |
| 118 | 793 | GCUCUCCAGCCUCAUCAUC | 1090 | GAUGAUGAGGCUGGAGAGC | Rh, D, Rt, M, P | [1018- |
| 119 | 794 | AGAAGGCUGUUGCCAUCUC | 1091 | GAGAUGGCAACAGCCUUCU | Rt | [1125- |
| 120 | 795 | GGUCACCAAGGACGUGGAG | 1092 | CUCCACGUCCUUGGUGACC | Rh, D | [790-808] |
| 121 | 796 | AGCUGCGCGACGAGGAGGU | 1093 | ACCUCCUCGUCGCGCAGCU | Rh, D | [531-549] |
| 122 | 797 | CCCGAGGUCACCAAGGACG | 1094 | CGUCCUUGGUGACCUCGGG | Rh, D | [785-803] |
| 123 | 798 | AUGUCAGGCAAGAAGGACC | 1095 | GGUCCUUCUUGCCUGACAU | Rh, D | [1247- |
| 124 | 799 | CGAGGUCACCAAGGACGUG | 1096 | CACGUCCUUGGUGACCUCG | Rh, D | [787-805] |
| 125 | 800 | GAUGCACCGGACAGGCCUC | 1097 | GAGGCCUGUCCGGUGCAUC | Rh, Rb, Rt, M, P | [937-955] |
| 126 | 801 | GCACUACAACUGCGAGCAC | 1098 | GUGCUCGCAGUUGUAGUGC | Rh, D | [685-703] |
| 127 | 802 | CCACAAGAUGGUGGACAAC | 1099 | GUUGUCCACCAUCUUGUGG | Rh, Rb, M, P | [874-892] |
| 128 | 803 | CAAGGGUGUGGUGGAGGUG | 1100 | CACCUCCACCACACCCUUG | Rh, D | [1150- |
| 129 | 804 | AGCUGAAGAUCUGGAUGGG | 1101 | CCCAUCCAGAUCUUCAGCU | Rh, D | [1095- |
| 130 | 805 | ACCAGGCCAUGGCCAAGGA | 1102 | UCCUUGGCCAUGGCCUGGU | Rh, D | [393-411] |
| 131 | 806 | CAUGUUCUUCAAGCCACAC | 1103 | GUGUGGCUUGAAGAACAUG | Rh, Rb, D | [838-856] |
| 132 | 807 | CAAGAUCAACUUCCGCGAC | 1104 | GUCGCGGAAGUUGAUCUUG | D | [706-724] |
| 133 | 808 | UCCAGCCUCAUCAUCCUCA | 1105 | UGAGGAUGAUGAGGCUGGA | Rh, D, Rt, M | [1022- |
| 134 | 809 | GCCCGAGGUCACCAAGGAC | 1106 | GUCCUUGGUGACCUCGGGC | Rh, D | [784-802] |
| 135 | 810 | UCAAGCCACACUGGGAUGA | 1107 | UCAUCCCAGUGUGGCUUGA | Rh, Rb | [846-864] |
| 136 | 811 | AGUCCAUCAACGAGUGGGC | 1108 | GCCCACUCGUUGAUGGACU | Rh, Rt, M | [741-759] |
| 137 | 812 | GACUUCGUGCGCAGCAGCA | 1109 | UGCUGCUGCGCACGAAGUC | Rh, D, M | [662-680] |
| 138 | 813 | CUCUCCAGCCUCAUCAUCC | 1110 | GGAUGAUGAGGCUGGAGAG | Rh, D, Rt, M, P | [1019- |

TABLE C-continued

Cross-Species 19-mer SERPINH1 siRNAs

| No. | SEQ ID SEN | Sense siRNA | SEQ ID AS | AntiSense siRNA | Other Species | human- |
|---|---|---|---|---|---|---|
| 139 | 814 | GCAGACCACCGACGGCAAG | 1111 | CUUGCCGUCGGUGGUCUGC | D, Rt | [763-781] |
| 140 | 815 | AUGCAGAAGAAGGCUGUUG | 1112 | CAACAGCCUUCUUCUGCAU | Rt | [1118- |
| 141 | 816 | CAACCGUGGCUUCAUGGUG | 1113 | CACCAUGAAGCCACGGUUG | Rh, Rt, M | [889-907] |
| 142 | 817 | UACUACGACGACGAGAAGG | 1114 | CCUUCUCGUCGUCGUAGUA | Rb | [962-980] |
| 143 | 818 | GAAGGCUGUUGCCAUCUCC | 1115 | GGAGAUGGCAACAGCCUUC | Rt | [1126- |
| 144 | 819 | UCACCAAGGACGUGGAGCG | 1116 | CGCUCCACGUCCUUGGUGA | Rh, D | [792-810] |
| 145 | 820 | CAGCUGAAGAUCUGGAUGG | 1117 | CCAUCCAGAUCUUCAGCUG | Rh, D | [1094- |
| 146 | 821 | UGGGCCUGACUGAGGCCAU | 1118 | AUGGCCUCAGUCAGGCCCA | Rt | [1200- |
| 147 | 822 | ACCGUGGCUUCAUGGUGAC | 1119 | GUCACCAUGAAGCCACGGU | Rh, Rt, M | [891-909] |
| 148 | 823 | CAGUCCAUCAACGAGUGGG | 1120 | CCCACUCGUUGAUGGACUG | Rh, Rt, M | [740-758] |
| 149 | 824 | CCGACGGCAAGCUGCCCGA | 1121 | UCGGGCAGCUUGCCGUCGG | D | [771-789] |
| 150 | 825 | ACAAGCGCAGCGCGCUGCA | 1122 | UGCAGCGCGCUGCGCUUGU | Rh, Rt | [723-741] |
| 151 | 826 | GAAACACCUGGCUGGGCUG | 1123 | CAGCCCAGCCAGGUGUUUC | D | [1183- |
| 152 | 827 | AGGCUCCUGAGACACAUGG | 1124 | CCAUGUGUCUCAGGAGCCU | D | [1525- |
| 153 | 828 | CAAGGACGUGGAGCGCACG | 1125 | CGUGCGCUCCACGUCCUUG | Rh, D | [796-814] |
| 154 | 829 | GCAGUCCAUCAACGAGUGG | 1126 | CCACUCGUUGAUGGACUGC | Rh, Rt, M | [739-757] |
| 155 | 830 | AGAUGGUGGACAACCGUGG | 1127 | CCACGGUUGUCCACCAUCU | Rh, M | [879-897] |
| 156 | 831 | AAGCGCAGCGCGCUGCAGU | 1128 | ACUGCAGCGCGCUGCGCUU | Rh, Rt | [725-743] |
| 157 | 832 | CAUGUCAGGCAAGAAGGAC | 1129 | GUCCUUCUUGCCUGACAUG | Rh, D | [1246- |
| 158 | 833 | CAAGCCACACUGGGAUGAG | 1130 | CUCAUCCCAGUGUGGCUUG | Rh, Rb | [847-865] |
| 159 | 834 | AAGAUGCAGAAGAAGGCUG | 1131 | CAGCCUUCUUCUGCAUCUU | Rh, Rt, M | [1115- |
| 160 | 835 | GGCCAUGGCCAAGGACCAG | 1132 | CUGGUCCUUGGCCAUGGCC | Rh, D | [397-415] |
| 161 | 836 | GUGCGCAGCAGCAAGCAGC | 1133 | GCUGCUUGCUGCUGCGCAC | Rh, D | [668-686] |
| 162 | 837 | CAACUGCGAGCACUCCAAG | 1134 | CUUGGAGUGCUCGCAGUUG | Rh, D | [691-709] |
| 163 | 838 | UACAACUGCGAGCACUCCA | 1135 | UGGAGUGCUCGCAGUUGUA | Rh, D | [689-707] |
| 164 | 839 | CAUUGACAAGAACAAGGCC | 1136 | GGCCUUGUUCUUGUCAAUG | Rh, D | [1216- |
| 165 | 840 | CAAGCAGCACUACAACUGC | 1137 | GCAGUUGUAGUGCUGCUUG | Rh, D | [679-697] |
| 166 | 841 | GUGUUCCACGCCACCGCCU | 1138 | AGGCGGUGGCGUGGAACAC | D | [1280- |
| 167 | 842 | CCUGCUAUUCAUUGGGCGC | 1139 | GCGCCCAAUGAAUAGCAGG | D | [1426- |
| 168 | 843 | GCCCACAAGCUCUCCAGCC | 1140 | GGCUGGAGAGCUUGUGGGC | Rh, D, P | [1010- |
| 169 | 844 | CAGCAGCAAGCAGCACUAC | 1141 | GUAGUGCUGCUUGCUGCUG | Rh, D | [673-691] |
| 170 | 845 | UGAUGCACCGGACAGGCCU | 1142 | AGGCCUGUCCGGUGCAUCA | Rh, Rb, Rt, M, P | [936-954] |
| 171 | 846 | UCAACUUCCGCGACAAGCG | 1143 | CGCUUGUCGCGGAAGUUGA | D | [711-729] |
| 172 | 847 | UCAGGCAAGAAGGACCUGU | 1144 | ACAGGUCCUUCUUGCCUGA | Rh, D | [1250- |
| 173 | 848 | ACUUCGUGCGCAGCAGCAA | 1145 | UUGCUGCUGCGCACGAAGU | Rh, D, M | [663-681] |
| 174 | 849 | ACAACCGUGGCUUCAUGGU | 1146 | ACCAUGAAGCCACGGUUGU | Rh, Rt, M | [888-906] |
| 175 | 850 | AAGGCUGUUGCCAUCUCCU | 1147 | AGGAGAUGGCAACAGCCUU | D, Rt | [1127- |
| 176 | 851 | GCAGCUGCGCGAGGAGGAG | 1148 | CUCCUCGUCGCGCAGCUGC | Rh, D | [529-547] |

TABLE C-continued

Cross-Species 19-mer SERPINH1 siRNAs

| No. | SEQ ID SEN | Sense siRNA | SEQ ID AS | AntiSense siRNA | Other Species | human- |
|---|---|---|---|---|---|---|
| 177 | 852 | UAUUCAUUGGGCGCCUGGU | 1149 | ACCAGGCGCCCAAUGAAUA | D | [1431- |
| 178 | 853 | UCCACCACAAGAUGGUGGA | 1150 | UCCACCAUCUUGUGGUGGA | Rh, Rb, D, P | [870-888] |
| 179 | 854 | CCCUGGCCCACAAGCUCUC | 1151 | GAGAGCUUGUGGGCCAGGG | Rh, D, P | [1005- |
| 180 | 855 | ACCAGGACAUCUACGGGCG | 1152 | CGCCCGUAGAUGUCCUGGU | D, Rt | [1329- |
| 181 | 856 | GAUGAUGCACCGGACAGGC | 1153 | GCCUGUCCGGUGCAUCAUC | Rh, Rb, Rt, M | [934-952] |
| 182 | 857 | CAACGCCAUGUUCUUCAAG | 1154 | CUUGAAGAACAUGGCGUUG | Rh, Rb, P | [832-850] |
| 183 | 858 | ACGGCAAGCUGCCCGAGGU | 1155 | ACCUCGGGCAGCUUGCCGU | Rh, D | [774-792] |
| 184 | 859 | CAGCGCGCUGCAGUCCAUC | 1156 | GAUGGACUGCAGCGCGCUG | Rh, Rt | [730-748] |
| 185 | 860 | CCCAAGGGUGUGGUGGAGG | 1157 | CCUCCACCACACCCUUGGG | Rh, D | [1148- |
| 186 | 861 | CAUGGCCAAGGACCAGGCA | 1158 | UGCCUGGUCCUUGGCCAUG | Rh, D | [400-418] |
| 187 | 862 | CUCCAGCCUCAUCAUCCUC | 1159 | GAGGAUGAUGAGGCUGGAG | Rh, D, Rt, M | [1021- |
| 188 | 863 | UCUACGGGCGCGAGGAGCU | 1160 | AGCUCCUCGCGCCCGUAGA | D, M | [1338- |
| 189 | 864 | GGCCCACAAGCUCUCCAGC | 1161 | GCUGGAGAGCUUGUGGGCC | Rh, D, P | [1009- |
| 190 | 865 | GUCAGGCAAGAAGGACCUG | 1162 | CAGGUCCUUCUUGCCUGAC | Rh, D | [1249- |
| 191 | 866 | CAUCUACGGGCGCGAGGAG | 1163 | CUCCUCGCGCCCGUAGAUG | D, M | [1336- |
| 192 | 867 | CGUGCGCAGCAGCAAGCAG | 1164 | CUGCUUGCUGCUGCGCACG | Rh, D, M | [667-685] |
| 193 | 868 | AGCCUCAUCAUCCUCAUGC | 1165 | GCAUGAGGAUGAUGAGGCU | Rh, D, Rt, M | [1025- |
| 194 | 869 | UUCAAGCCACACUGGGAUG | 1166 | CAUCCCAGUGUGGCUUGAA | Rh, Rb | [845-863] |
| 195 | 870 | AAGAAGGCUGUUGCCAUCU | 1167 | AGAUGGCAACAGCCUUCUU | Rt | [1124- |
| 196 | 871 | GGUGUGGUGGAGGUGACCC | 1168 | GGGUCACCUCCACCACACC | Rh, D | [1154- |
| 197 | 872 | GAGGUGACCCAUGACCUGC | 1169 | GCAGGUCAUGGGUCACCUC | Rh, Rt, M | [1163- |
| 198 | 873 | GUGGAGGUGACCCAUGACC | 1170 | GGUCAUGGGUCACCUCCAC | Rh, Rt, M | [1160- |
| 199 | 874 | CACAAGAUGGUGGACAACC | 1171 | GGUUGUCCACCAUCUUGUG | Rh, Rb, M, P | [875-893] |
| 200 | 875 | CUGGCCCACAAGCUCUCCA | 1172 | UGGAGAGCUUGUGGGCCAG | Rh, D, P | [1007- |
| 201 | 876 | GAUGACUUCGUGCGCAGCA | 1173 | UGCUGCGCACGAAGUCAUC | Rh, Rt, M | [659-677] |
| 202 | 877 | ACUUCCGCGACAAGCGCAG | 1174 | CUGCGCUUGUCGCGGAAGU | D | [714-732] |
| 203 | 878 | AACGCCAUGUUCUUCAAGC | 1175 | GCUUGAAGAACAUGGCGUU | Rh, Rb, P | [833-851] |
| 204 | 879 | GGACCUGUACCUGGCCAGC | 1176 | GCUGGCCAGGUACAGGUCC | Rh, D | [1261- |
| 205 | 880 | GCGACGAGGAGGUGCACGC | 1177 | GCGUGCACCUCCUCGUCGC | D | [537-555] |
| 206 | 881 | GCAAGCUGCCCGAGGUCAC | 1178 | GUGACCUCGGGCAGCUUGC | Rh, D | [777-795] |
| 207 | 882 | AUUCAUUGGGCGCCUGGUC | 1179 | GACCAGGCGCCCAAUGAAU | D | [1432- |
| 208 | 883 | GAGGUCACCAAGGACGUGG | 1180 | CCACGUCCUUGGUGACCUC | Rh, D | [788-806] |
| 209 | 884 | AAGAAGGACCUGUACCUGG | 1181 | CCAGGUACAGGUCCUUCUU | Rh, D | [1256- |
| 210 | 885 | GACAACCGUGGCUUCAUGG | 1182 | CCAUGAAGCCACGGUUGUC | Rh, Rt, M | [887-905] |
| 211 | 886 | CUGGGCCUGACUGAGGCCA | 1183 | UGGCCUCAGUCAGGCCCAG | Rt | [1199- |
| 212 | 887 | CUCCAAGAUCAACUUCCGC | 1184 | GCGGAAGUUGAUCUUGGAG | Rh, D, Rt, M | [703-721] |
| 213 | 888 | CAACUUCCGCGACAAGCGC | 1185 | GCGCUUGUCGCGGAAGUUG | D | [712-730] |
| 214 | 889 | CUCCCUGCUAUUCAUUGGG | 1186 | CCCAAUGAAUAGCAGGGAG | D | [1423- |

TABLE C-continued

Cross-Species 19-mer SERPINH1 siRNAs

| No. | SEQ ID SEN | Sense siRNA | SEQ ID AS | AntiSense siRNA | Other Species | human- |
|---|---|---|---|---|---|---|
| 215 | 890 | AAGCAGCACUACAACUGCG | 1187 | CGCAGUUGUAGUGCUGCUU | Rh, D | [680-698] |
| 216 | 891 | GCGCAGCAGCAAGCAGCAC | 1188 | GUGCUGCUUGCUGCUGCGC | Rh, D | [670-688] |
| 217 | 892 | CAGGCCAUGGCCAAGGACC | 1189 | GGUCCUUGGCCAUGGCCUG | Rh, D | [395-413] |
| 218 | 893 | GUACCAGGCCAUGGCCAAG | 1190 | CUUGGCCAUGGCCUGGUAC | Rh, D | [391-409] |
| 219 | 894 | CUUCGUGCGCAGCAGCAAG | 1191 | CUUGCUGCUGCGCACGAAG | Rh, D, M | [664-682] |
| 220 | 895 | CAGCACUACAACUGCGAGC | 1192 | GCUCGCAGUUGUAGUGCUG | Rh, D | [683-701] |
| 221 | 896 | UACAACUACUACGACGACG | 1193 | CGUCGUCGUAGUAGUUGUA | Rb | [956-974] |
| 222 | 897 | GAUGGUGGACAACCGUGGC | 1194 | GCCACGGUUGUCCACCAUC | Rh, M | [880-898] |
| 223 | 898 | CUACAACUGCGAGCACUCC | 1195 | GGAGUGCUCGCAGUUGUAG | Rh, D | [688-706] |
| 224 | 899 | AAGGACCUGUACCUGGCCA | 1196 | UGGCCAGGUACAGGUCCUU | Rh, D | [1259- |
| 225 | 900 | GCUGCCCGAGGUCACCAAG | 1197 | CUUGGUGACCUCGGGCAGC | Rh, D | [781-799] |
| 226 | 901 | GACAUCUACGGGCGCGAGG | 1198 | CCUCGCGCCCGUAGAUGUC | D, M | [1334- |
| 227 | 902 | CCACCACAAGAUGGUGGAC | 1199 | GUCCACCAUCUUGUGGUGG | Rh, Rb, D, P | [871-889] |
| 228 | 903 | GCGCGACGAGGAGGUGCAC | 1200 | GUGCACCUCCUCGUCGCGC | Rh, D | [535-553] |
| 229 | 904 | CUAUUCAUUGGGCGCCUGG | 1201 | CCAGGCGCCCAAUGAAUAG | D | [1430- |
| 230 | 905 | CCAGGACAUCUACGGGCGC | 1202 | GCGCCCGUAGAUGUCCUGG | D, Rt | [1330- |
| 231 | 906 | AAGAUGGUGGACAACCGUG | 1203 | CACGGUUGUCCACCAUCUU | Rh, M | [878-896] |
| 232 | 907 | CAGGACAUCUACGGGCGCG | 1204 | CGCGCCCGUAGAUGUCCUG | D | [1331- |
| 233 | 908 | UCCAAGAUCAACUUCCGCG | 1205 | CGCGGAAGUUGAUCUUGGA | D | [704-722] |
| 234 | 909 | GUCACCAAGGACGUGGAGC | 1206 | GCUCCACGUCCUUGGUGAC | Rh, D | [791-809] |
| 235 | 910 | CUGCCCGAGGUCACCAAGG | 1207 | CCUUGGUGACCUCGGGCAG | Rh, D | [782-800] |
| 236 | 911 | GACCAGGACAUCUACGGGC | 1208 | GCCCGUAGAUGUCCUGGUC | D, Rt | [1328- |
| 237 | 912 | CCAUGGCCAAGGACCAGGC | 1209 | GCCUGGUCCUUGGCCAUGG | Rh, D | [399-417] |
| 238 | 913 | CACCAAGGACGUGGAGCGC | 1210 | GCGCUCCACGUCCUUGGUG | Rh, D | [793-811] |
| 239 | 914 | GACAAGCGCAGCGCGCUGC | 1211 | GCAGCGCGCUGCGCUUGUC | Rh, Rt | [722-740] |
| 240 | 915 | CAAGCGCAGCGCGCUGCAG | 1212 | CUGCAGCGCGCUGCGCUUG | Rh, Rt | [724-742] |
| 241 | 916 | CAGACCACCGACGGCAAGC | 1213 | GCUUGCCGUCGGUGGUCUG | D, Rt | [764-782] |
| 242 | 917 | GACCACCGACGGCAAGCUG | 1214 | CAGCUUGCCGUCGGUGGUC | D, Rt | [766-784] |
| 243 | 918 | AGGACCUGUACCUGGCCAG | 1215 | CUGGCCAGGUACAGGUCCU | Rh, D | [1260- |
| 244 | 919 | CUGCUAUUCAUUGGGCGCC | 1216 | GGCGCCCAAUGAAUAGCAG | D | [1427- |
| 245 | 920 | UCAUUGGGCGCCUGGUCCG | 1217 | CGGACCAGGCGCCCAAUGA | Rh, D | [1434- |
| 246 | 921 | GCUGCGCGACGAGGAGGUG | 1218 | CACCUCCUCGUCGCGCAGC | Rh, D | [532-550] |
| 247 | 922 | CGGCAAGCUGCCCGAGGUC | 1219 | GACCUCGGGCAGCUUGCCG | Rh, D | [775-793] |
| 248 | 923 | CCUCAUCAUCCUCAUGCCC | 1220 | GGGCAUGAGGAUGAUGAGG | Rh, D, Rt, M | [1027- |
| 249 | 924 | CCAGGCCAUGGCCAAGGAC | 1221 | GUCCUUGGCCAUGGCCUGG | Rh, D | [394-412] |
| 250 | 925 | GCCAUGGCCAAGGACCAGG | 1222 | CCUGGUCCUUGGCCAUGGC | Rh, D | [398-416] |
| 251 | 926 | CCACCGACGGCAAGCUGCC | 1223 | GGCAGCUUGCCGUCGGUGG | D, Rt | [768-786] |
| 252 | 927 | AUGGUGGACAACCGUGGCU | 1224 | AGCCACGGUUGUCCACCAU | Rh, M | [881-899] |

TABLE C-continued

Cross-Species 19-mer SERPINH1 siRNAs

| No. | SEQ ID SEN | Sense siRNA | SEQ ID AS | AntiSense siRNA | Other Species | human- |
|---|---|---|---|---|---|---|
| 253 | 928 | CUUCCGCGACAAGCGCAGC | 1225 | GCUGCGCUUGUCGCGGAAG | D | [715-733] |
| 254 | 929 | CGCGACGAGGAGGUGCACG | 1226 | CGUGCACCUCCUCGUCGCG | Rh, D | [536-554] |
| 255 | 930 | UGGCCCACAAGCUCUCCAG | 1227 | CUGGAGAGCUUGUGGGCCA | Rh, D, P | [1008- |
| 256 | 931 | GAGCAGCUGCGCGACGAGG | 1228 | CCUCGUCGCGCAGCUGCUC | Rh, D | [527-545] |
| 257 | 932 | UGACCAGGACAUCUACGGG | 1229 | CCCGUAGAUGUCCUGGUCA | Rt | [1327- |
| 258 | 933 | ACCACCGACGGCAAGCUGC | 1230 | GCAGCUUGCCGUCGGUGGU | D, Rt | [767-785] |
| 259 | 934 | GAAGGACCUGUACCUGGCC | 1231 | GGCCAGGUACAGGUCCUUC | Rh, D | [1258- |
| 260 | 935 | CAUUGGGCGCCUGGUCCGG | 1232 | CCGGACCAGGCGCCCAAUG | Rh, D | [1435- |
| 261 | 936 | AUGCACCGGACAGGCCUCU | 1233 | AGAGGCCUGUCCGGUGCAU | Rh, Rb, Rt, P | [938-956] |
| 262 | 937 | AUCAACUUCCGCGACAAGC | 1234 | GCUUGUCGCGGAAGUUGAU | D | [710-728] |
| 263 | 938 | CAGCUGCGCGACGAGGAGG | 1235 | CCUCCUCGUCGCGCAGCUG | Rh, D | [530-548] |
| 264 | 939 | CAGAAACACCUGGCUGGGC | 1236 | GCCCAGCCAGGUGUUUCUG | D | [1181- |
| 265 | 940 | CUACGGGCGCGAGGAGCUG | 1237 | CAGCUCCUCGCGCCCGUAG | D, M | [1339- |
| 266 | 941 | CGACGAGGAGGUGCACGCC | 1238 | GGCGUGCACCUCCUCGUCG | D | [538-556] |
| 267 | 942 | UUUGACCAGGACAUCUACG | 1239 | CGUAGAUGUCCUGGUCAAA | Rt | [1325- |
| 268 | 943 | GUCCAUCAACGAGUGGGCC | 1240 | GGCCCACUCGUUGAUGGAC | Rh, Rt, M | [742-760] |
| 269 | 944 | AUGACUUCGUGCGCAGCAG | 1241 | CUGCUGCGCACGAAGUCAU | Rh, Rt, M | [660-678] |
| 270 | 945 | UCCCUGCUAUUCAUUGGGC | 1242 | GCCCAAUGAAUAGCAGGGA | D | [1424- |
| 271 | 946 | CUGCGCGACGAGGAGGUGC | 1243 | GCACCUCCUCGUCGCGCAG | Rh, D | [533-551] |
| 272 | 947 | CAAGCUGCCCGAGGUCACC | 1244 | GGUGACCUCGGGCAGCUUG | Rh, D | [778-796] |
| 273 | 948 | AAGCUGCCCGAGGUCACCA | 1245 | UGGUGACCUCGGGCAGCUU | Rh, D | [779-797] |
| 274 | 949 | UUCUUCAAGCCACACUGGG | 1246 | CCCAGUGUGGCUUGAAGAA | Rh, Rb, D | [842-860] |
| 275 | 950 | ACACCUGGCUGGGCUGGGC | 1247 | GCCCAGCCCAGCCAGGUGU | D | [1186- |
| 276 | 951 | UCCAUCAACGAGUGGGCCG | 1248 | CGGCCCACUCGUUGAUGGA | Rt, M | [743-761] |
| 277 | 952 | AUCUACGGGCGCGAGGAGC | 1249 | GCUCCUCGCGCCCGUAGAU | D, M | [1337- |
| 278 | 953 | UCGUGCGCAGCAGCAAGCA | 1250 | UGCUUGCUGCUGCGCACGA | Rh, D, M | [666-684] |
| 279 | 954 | CGACGGCAAGCUGCCCGAG | 1251 | CUCGGGCAGCUUGCCGUCG | D | [772-790] |
| 280 | 955 | UUCAUUGGGCGCCUGGUCC | 1252 | GGACCAGGCGCCCAAUGAA | Rh, D | [1433- |
| 281 | 956 | UUGACCAGGACAUCUACGG | 1253 | CCGUAGAUGUCCUGGUCAA | Rt | [1326- |
| 282 | 957 | CCUGGCCCACAAGCUCUCC | 1254 | GGAGAGCUUGUGGGCCAGG | Rh, D, P | [1006- |
| 283 | 958 | UGACUUCGUGCGCAGCAGC | 1255 | GCUGCUGCGCACGAAGUCA | Rh, Rt, M | [661-679] |
| 284 | 959 | AUGAUGCACCGGACAGGCC | 1256 | GGCCUGUCCGGUGCAUCAU | Rh, Rb, Rt, M, P | [935-953] |
| 285 | 960 | CACCGACGGCAAGCUGCCC | 1257 | GGGCAGCUUGCCGUCGGUG | D, Rt | [769-787] |
| 286 | 961 | GACGGCAAGCUGCCCGAGG | 1258 | CCUCGGGCAGCUUGCCGUC | Rh, D | [773-791] |
| 287 | 962 | UACCAGGCCAUGGCCAAGG | 1259 | CCUUGGCCAUGGCCUGGUA | Rh, D | [392-410] |
| 288 | 963 | UCCGCGACAAGCGCAGCGC | 1260 | GCGCUGCGCUUGUCGCGGA | D | [717-735] |
| 289 | 964 | UUCCGCGACAAGCGCAGCG | 1261 | CGCUGCGCUUGUCGCGGAA | D | [716-734] |
| 290 | 965 | AAGGACGUGGAGCGCACGG | 1262 | CCGUGCGCUCCACGUCCUU | Rh, D | [797-815] |

TABLE C-continued

Cross-Species 19-mer SERPINH1 siRNAs

| No. | SEQ ID SEN | Sense siRNA | SEQ ID AS | AntiSense siRNA | Other Species | human- |
|---|---|---|---|---|---|---|
| 291 | 966 | UUCCACCACAAGAUGGUGG | 1263 | CCACCAUCUUGUGGUGGAA | Rh, Rb, D, P | [869-887] |
| 292 | 967 | UACGGGCGCGAGGAGCUGC | 1264 | GCAGCUCCUCGCGCCCGUA | D, M | [1340- |
| 293 | 968 | AAACACCUGGCUGGGCUGG | 1265 | CCAGCCCAGCCAGGUGUUU | D | [1184- |
| 294 | 969 | AACACCUGGCUGGGCUGGG | 1266 | CCCAGCCCAGCCAGGUGUU | D | [1185- |
| 295 | 970 | AUUGGGCGCCUGGUCCGGC | 1267 | GCCGGACCAGGCGCCCAAU | Rh, D | [1436- |
| 296 | 971 | ACCGACGGCAAGCUGCCCG | 1268 | CGGGCAGCUUGCCGUCGGU | D | [770-788] |
| 297 | 972 | UUCGUGCGCAGCAGCAAGC | 1269 | GCUUGCUGCUGCGCACGAA | Rh, D, M | [665-683] |

TABLE D

SERPINH1 Active 18 + 1-mer siRNAs

| No | SEQ ID | Sense siRNA | SEQ ID | AntiSense siRNA | Other Sp | human- |
|---|---|---|---|---|---|---|
| 1 | 1270 | AGCCUUUGUUGCUAUCAAA | 1849 | UUUGAUAGCAACAAAGGCU | Rh | [2117-2135] |
| 2 | 1271 | GCCUAAGGGUGACAAGAUA | 1850 | UAUCUUGUCACCCUUAGGC | Rh | [1453-1471] |
| 3 | 1272 | GGCCUAAGGGUGACAAGAA | 1851 | UUCUUGUCACCCUUAGGCC | Rh | [1452-1470] |
| 4 | 1273 | CCUCAAUCAGUAUUCAUAA | 1852 | UUAUGAAUACUGAUUGAG | | [1774-1792] |
| 5 | 1274 | GGCGGAUUGAGAAGGAGCA | 1853 | UGCUCCUUCUCAAUCCGCC | | [1973-1991] |
| 6 | 1275 | GGCAGUGGAGAACAUCCUA | 1854 | UAGGAUGUUCUCCACUGCC | Rh | [415-433] |
| 7 | 1276 | GGGUCAGCCAGCCCUCUUA | 1855 | UAAGAGGGCUGGCUGACCC | Rh | [1839-1857] |
| 8 | 1277 | GGGUGACAAGAUGCGAGAA | 1856 | UUCUCGCAUCUUGUCACCC | Rh, D | [1459-1477] |
| 9 | 1278 | GGACCAGGCAGUGGAGAAA | 1857 | UUUCUCCACUGCCUGGUCC | Rh | [409-427] |
| 10 | 1279 | GAGACACAUGGGUGCUAUA | 1858 | UAUAGCACCCAUGUGUCUC | Rh, D, Rt, | [1533-1551] |
| 11 | 1280 | GUUGGAGCGUGGAAAAAAA | 1859 | UUUUUUUCCACGCUCCAAC | | [2191-2208] |
| 12 | 1281 | GGAACAUGAGCCUUUGUUA | 1860 | UAACAAAGGCUCAUGUUCC | Rh | [2109-2127] |
| 13 | 1282 | GCCAUGUUCUUCAAGCCAA | 1861 | UUGGCUUGAAGAACAUGGC | Rh, Rb, D | [836-854] |
| 14 | 1283 | GGAUUGAGAAGGAGCUCCA | 1862 | UGGAGCUCCUUCUCAAUCC | | [1976-1994] |
| 15 | 1284 | GGGAUGAACUUUUUGUUUA | 1863 | UAAACAAAAGUUCAUCCC | Rh | [2048-2066] |
| 16 | 1285 | GCCGCAGUGAGGCGGAUUA | 1864 | UAAUCCGCCUCACUGCGGC | | [1963-1981] |
| 17 | 1286 | GGACCUUCCCAGCUAGAAA | 1865 | UUUCUAGCUGGGAAGGUCC | Rh | [1639-1657] |
| 18 | 1287 | GACCUUCCCAGCUAGAAUA | 1866 | UAUUCUAGCUGGGAAGGUC | | [1640-1658] |
| 19 | 1288 | CCUGUGAGACCAAAUUGAA | 1867 | UUCAAUUUGGUCUCACAGG | Rh | [1814-1832] |
| 20 | 1289 | UGGAGAACAUCCUGGUGUA | 1868 | UACACCAGGAUGUUCUCCA | | [420-438] |
| 21 | 1290 | GCCUUUGUUGCUAUCAAUA | 1869 | UAUUGAUAGCAACAAAGGC | Rh | [2118-2136] |
| 22 | 1291 | CCGCCUUUGAGUUGGACAA | 1870 | UUGUCCAACUCAAAGGCGG | | [1293-1311] |
| 23 | 1292 | CAGGCAGUGGAGAACAUCA | 1871 | UGAUGUUCUCCACUGCCUG | Rh | [413-431] |
| 24 | 1293 | CACCUGUGAGACCAAAUUA | 1872 | UAAUUUGGUCUCACAGGUG | Rh | [1812-1830] |
| 25 | 1294 | GGGAAGAUGCAGAAGAAGA | 1873 | UCUUCUUCUGCAUCUUCCC | Rh, Rb, Rt | [1112-1130] |
| 26 | 1295 | GGCCAUUGACAAGAACAAA | 1874 | UUUGUUCUUGUCAAUGGCC | Rh, D | [1213-1231] |

TABLE D-continued

SERPINH1 Active 18 + 1-mer siRNAs

| No | SEQ ID | Sense siRNA | SEQ ID | AntiSense siRNA | Other Sp | human- |
|---|---|---|---|---|---|---|
| 27 | 1296 | GCCUUUGAGUUGGACACAA | 1875 | UUGUGUCCAACUCAAAGGC | Rh | [1295-1313] |
| 28 | 1297 | AGCGGACCUUCCCAGCUAA | 1876 | UUAGCUGGGAAGGUCCGCU | Rh | [1636-1654] |
| 29 | 1298 | GAAGAAGGCUGUUGCCAUA | 1877 | UAUGGCAACAGCCUUCUUC | Rt | [1123-1141] |
| 30 | 1299 | ACAAGAUGCGAGACGAGUA | 1878 | UACUCGUCUCGCAUCUUGU | Rh, Rt | [1464-1482] |
| 31 | 1300 | GAGGCGGAUUGAGAAGGAA | 1879 | UUCCUUCUCAAUCCGCCUC | | [1971-1989] |
| 32 | 1301 | GGACAACCGUGGCUUCAUA | 1880 | UAUGAAGCCACGGUUGUCC | Rh, M | [886-904] |
| 33 | 1302 | CAUAUUUAUAGCCAGGUAA | 1881 | UUACCUGGCUAUAAAUAUG | Rh | [1788-1806] |
| 34 | 1303 | CGACGACGAGAAGGAAAAA | 1882 | UUUUUCCUUCUCGUCGUCG | | [967-985] |
| 35 | 1304 | CUCACCUGUGAGACCAAAA | 1883 | UUUUGGUCUCACAGGUGAG | Rh | [1810-1828] |
| 36 | 1305 | GCGGCUCCCUGCUAUUCAA | 1884 | UUGAAUAGCAGGGAGCCGC | | [1419-1437] |
| 37 | 1306 | AGAACAUCCUGGUGUCACA | 1885 | UGUGACACCAGGAUGUUCU | | [423-441] |
| 38 | 1307 | CACACUGGGAUGAGAAAUA | 1886 | UAUUUCUCAUCCCAGUGUG | Rh | [852-870] |
| 39 | 1308 | GCUAGAAUUCACUCCACUA | 1887 | UAGUGGAGUGAAUUCUAGC | Rh | [1650-1668] |
| 40 | 1309 | CCUUCAUCUUCCUAGUGCA | 1888 | UGCACUAGGAAGAUGAAGG | | [1389-1407] |
| 41 | 1310 | UGCUAUCAAUCCAAGAACA | 1889 | UGUUCUUGGAUUGAUAGCA | Rh | [2126-2144] |
| 42 | 1311 | GGAAGAUGCAGAAGAAGGA | 1890 | UCCUUCUUCUGCAUCUUCC | Rh, Rb, Rt | [1113-1131] |
| 43 | 1312 | CAUGAGCCUUUGUUGCUAA | 1891 | UUAGCAACAAAGGCUCAUG | Rh | [2113-2131] |
| 44 | 1313 | GCGGAUUGAGAAGGAGCUA | 1892 | UAGCUCCUUCUCAAUCCGC | | [1974-1992] |
| 45 | 1314 | UGCAGUCCAUCAACGAGUA | 1893 | UACUCGUUGAUGGACUGCA | Rh, Rt, M | [738-756] |
| 46 | 1315 | GCACUGCGGAGAAGUUGAA | 1894 | UUCAACUUCUCCGCAGUGC | | [321-339] |
| 47 | 1316 | CCAGGCAGUGGAGAACAUA | 1895 | UAUGUUCUCCACUGCCUGG | Rh | [412-430] |
| 48 | 1317 | GGCAAGAAGGACCUGUACA | 1896 | UGUACAGGUCCUUCUUGCC | Rh, D, M | [1253-1271] |
| 49 | 1318 | CUCUACAACUACUACGACA | 1897 | UGUCGUAGUAGUUGUAGA | Rb | [953-971] |
| 50 | 1319 | CUUCCCAGCUAGAAUUCAA | 1898 | UUGAAUUCUAGCUGGGAAG | Rh | [1643-1661] |
| 51 | 1320 | AGGCGGAUUGAGAAGGAGA | 1899 | UCUCCUUCUCAAUCCGCCU | | [1972-1990] |
| 52 | 1321 | GGUCCUAUACCGUGGGUGA | 1900 | UCACCCACGGUAUAGGACC | Rh | [912-930] |
| 53 | 1322 | GCAAGAAGGACCUGUACCA | 1901 | UGGUACAGGUCCUUCUUGC | Rh, D, M | [1254-1272] |
| 54 | 1323 | CCGUGGGUGUCAUGAUGAA | 1902 | UUCAUCAUGACACCCACGG | Rh | [921-939] |
| 55 | 1324 | GAUGCGAGACGAGUUAUAA | 1903 | UUAUAACUCGUCUCGCAUC | Rh | [1468-1486] |
| 56 | 1325 | GGCAGUGCUGAGCGCCGAA | 1904 | UUCGGCGCUCAGCACUGCC | | [511-529] |
| 57 | 1326 | CAGCUAGAAUUCACUCCAA | 1905 | UUGGAGUGAAUUCUAGCUG | Rh | [1648-1666] |
| 58 | 1327 | GAGCUUCGCUGAUGACUUA | 1906 | UAAGUCAUCAGCGAAGCUC | | [649-667] |
| 59 | 1328 | CUUUGAGUUGGACACAGAA | 1907 | UUCUGUGUCCAACUCAAAG | Rh | [1297-1315] |
| 60 | 1329 | GGUGGACAACCGUGGCUUA | 1908 | UAAGCCACGGUUGUCCACC | Rh, M | [883-901] |
| 61 | 1330 | GCCUCAUCAUCCUCAUGCA | 1909 | UGCAUGAGGAUGAUGAGGC | Rh, D, Rt, | [1026-1044] |
| 62 | 1331 | ACCAGGCAGUGGAGAACAA | 1910 | UUGUUCUCCACUGCCUGGU | Rh | [411-429] |
| 63 | 1332 | CCUGCCUCAAUCAGUAUUA | 1911 | UAAUACUGAUUGAGGCAGG | | [1770-1788] |
| 64 | 1333 | GAUCAAGCCUGCCUCAAUA | 1912 | UAUUGAGGCAGGCUUGAUC | Rh | [1763-1781] |

TABLE D-continued

SERPINH1 Active 18 + 1-mer siRNAs

| No | SEQ ID | Sense siRNA | SEQ ID | AntiSense siRNA | Other Sp | human- |
|---|---|---|---|---|---|---|
| 65 | 1334 | CAGACUCUGGUCAAGAAGA | 1913 | UCUUCUUGACCAGAGUCUG | Rh | [2011-2029] |
| 66 | 1335 | CGCGCUGCAGUCCAUCAAA | 1914 | UUUGAUGGACUGCAGCGCG | Rh, Rt | [733-751] |
| 67 | 1336 | CUGGCACUGCGGAGAAGUA | 1915 | UACUUCUCCGCAGUGCCAG | | [318-336] |
| 68 | 1337 | CCAGCUCUAUCCCAACCUA | 1916 | UAGGUUGGGAUAGAGCUG | | [1885-1903] |
| 69 | 1338 | AGGGUGUGGUGGAGGUGAA | 1917 | UUCACCUCCACCACACCCU | Rh, D | [1152-1170] |
| 70 | 1339 | AGUGAGGCGGAUUGAGAAA | 1918 | UUUCUCAAUCCGCCUCACU | | [1968-1986] |
| 71 | 1340 | CGGACAGGCCUCUACAACA | 1919 | UGUUGUAGAGGCCUGUCCG | Rh, Rb, Rt, | [944-962] |
| 72 | 1341 | CGACGAGAAGGAAAAGCUA | 1920 | UAGCUUUUCCUUCUCGUCG | Rh | [970-988] |
| 73 | 1342 | AGGCCAAGGCAGUGCUGAA | 1921 | UUCAGCACUGCCUUGGCCU | Rh | [504-522] |
| 74 | 1343 | GCCUCAGGGUGCACACAGA | 1922 | UCUGUGUGCACCCUGAGGC | | [1488-1506] |
| 75 | 1344 | GGAUGAGAAAUUCCACCAA | 1923 | UUGGUGGAAUUUCUCAUCC | Rh | [859-877] |
| 76 | 1345 | AGAAGGAAAAGCUGCAAAA | 1924 | UUUUGCAGCUUUUCCUUCU | Rh | [975-993] |
| 77 | 1346 | AGCUCUAUCCCAACCUCUA | 1925 | UAGAGGUUGGGAUAGAGC | Rh | [1887-1905] |
| 78 | 1347 | UGACAAGAUGCGAGACGAA | 1926 | UUCGUCUCGCAUCUUGUCA | Rh | [1462-1480] |
| 79 | 1348 | AGAAGGAGCUCCCAGGAGA | 1927 | UCUCCUGGGAGCUCCUUCU | | [1982-2000] |
| 80 | 1349 | CCUUCUCACCUGUGAGACA | 1928 | UGUCUCACAGGUGAGAAGG | Rh | [1806-1824] |
| 81 | 1350 | GGCUUCUGGGCAGACUCUA | 1929 | UAGAGUCUGCCCAGAAGCC | Rh | [2001-2019] |
| 82 | 1351 | CCAGCCUCAUCAUCCUCAA | 1930 | UUGAGGAUGAUGAGGCUG | Rh, D, Rt, | [1023-1041] |
| 83 | 1352 | CCAAAGGCUCCUGAGACAA | 1931 | UUGUCUCAGGAGCCUUUGG | | [1521-1539] |
| 84 | 1353 | GGACCUGGGCCAUAGUCAA | 1932 | UUGACUAUGGCCCAGGUCC | | [1722-1740] |
| 85 | 1354 | GGGUGUCAUGAUGAUGCAA | 1933 | UUGCAUCAUCAUGACACCC | Rh | [925-943] |
| 86 | 1355 | GUACCAGCCUUGGAUACUA | 1934 | UAGUAUCCAAGGCUGGUAC | Rh | [1572-1590] |
| 87 | 1356 | GGCUGUUGCCAUCUCCUUA | 1935 | UAAGGAGAUGGCAACAGCC | | [1129-1147] |
| 88 | 1357 | CGCAGUGAGGCGGAUUGAA | 1936 | UUCAAUCCGCCUCACUGCG | | [1965-1983] |
| 89 | 1358 | CCAAGGACGUGGAGCGCAA | 1937 | UUGCGCUCCACGUCCUUGG | Rh, D | [795-813] |
| 90 | 1359 | GGCUCCUGAGACACAUGGA | 1938 | UCCAUGUGUCUCAGGAGCC | D | [1526-1544] |
| 91 | 1360 | GCUGCAGUCCAUCAACGAA | 1939 | UUCGUUGAUGGACUGCAGC | Rh, Rt | [736-754] |
| 92 | 1361 | CCAGGUACCUUCUCACCUA | 1940 | UAGGUGAGAAGGUACCUGG | Rh | [1799-1817] |
| 93 | 1362 | GCAGCGCGCUGCAGUCCAA | 1941 | UUGGACUGCAGCGCGCUGC | Rh, Rt | [729-747] |
| 94 | 1363 | GAGACCAAAUUGAGCUAGA | 1942 | UCUAGCUCAAUUUGGUCUC | | [1819-1837] |
| 95 | 1364 | GCCGCCGAGGUGAAGAAAA | 1943 | UUUUCUUCACCUCGGCGGC | | [281-299] |
| 96 | 1365 | GCAGACUCUGGUCAAGAAA | 1944 | UUUCUUGACCAGAGUCUGC | Rh | [2010-2028] |
| 97 | 1366 | CUAGAAUUCACUCCACUUA | 1945 | UAAGUGGAGUGAAUUCUA | Rh | [1651-1669] |
| 98 | 1367 | GCAGUGGAGAACAUCCUGA | 1946 | UCAGGAUGUUCUCCACUGC | Rh | [416-434] |
| 99 | 1368 | CGCAUGUCAGGCAAGAAGA | 1947 | UCUUCUUGCCUGACAUGCG | Rh, D | [1244-1262] |
| 10 | 1369 | CGGAUUGAGAAGGAGCUCA | 1948 | UGAGCUCCUUCUCAAUCCG | | [1975-1993] |
| 10 | 1370 | AGGUGAGGUACCAGCCUUA | 1949 | UAAGGCUGGUACCUCACCU | Rh | [1565-1583] |
| 10 | 1371 | CCACACUGGGAUGAGAAAA | 1950 | UUUUCUCAUCCCAGUGUGG | Rh | [851-869] |

TABLE D-continued

SERPINH1 Active 18 + 1-mer siRNAs

| No | SEQ ID | Sense siRNA | SEQ ID | AntiSense siRNA | Other Sp | human- |
|---|---|---|---|---|---|---|
| 10 | 1372 | GCCAUUGACAAGAACAAGA | 1951 | UCUUGUUCUUGUCAAUGGC | Rh, D | [1214-1232] |
| 10 | 1373 | GCGCUGCAGUCCAUCAACA | 1952 | UGUUGAUGGACUGCAGCGC | Rh, Rt | [734-752] |
| 10 | 1374 | CUCCCAACUAUAAAACUAA | 1953 | UUAGUUUAUAGUUGGGA | Rh | [1903-1921] |
| 10 | 1375 | GGUGACAAGAUGCGAGACA | 1954 | UGUCUCGCAUCUUGUCACC | Rh | [1460-1478] |
| 10 | 1376 | GGCCGACUUGUCACGCAUA | 1955 | UAUGCGUGACAAGUCGGCC | Rh | [1231-1249] |
| 10 | 1377 | CCUAAGGGUGACAAGAUGA | 1956 | UCAUCUUGUCACCCUUAGG | Rh | [1454-1472] |
| 10 | 1378 | UGAGACACAUGGGUGCUAA | 1957 | UUAGCACCCAUGUGUCUCA | Rh, D, Rt, | [1532-1550] |
| 11 | 1379 | GGGUGGAAAAACAGACCGA | 1958 | UCGGUCUGUUUUUCCACCC | | [1601-1619] |
| 11 | 1380 | GGUGGAGGUGACCCAUGAA | 1959 | UUCAUGGGUCACCUCCACC | Rh, Rt, M | [1159-1177] |
| 11 | 1381 | CUUUGACCAGGACAUCUAA | 1960 | UUAGAUGUCCUGGUCAAAG | Rh, Rt | [1324-1342] |
| 11 | 1382 | GAACAUGAGCCUUUGUUGA | 1961 | UCAACAAAGGCUCAUGUUC | Rh | [2110-2128] |
| 11 | 1383 | AGCCUUGGAUACUCCAUGA | 1962 | UCAUGGAGUAUCCAAGGCU | Rh | [1577-1595] |
| 11 | 1384 | GGAGGUGACCCAUGACCUA | 1963 | UAGGUCAUGGGUCACCUCC | Rh, Rt, M | [1162-1180] |
| 11 | 1385 | AGAUCAAGCCUGCCUCAAA | 1964 | UUUGAGGCAGGCUUGAUCU | Rh | [1762-1780] |
| 11 | 1386 | GCCCAAGGGUGUGGUGGAA | 1965 | UUCCACCACACCCUUGGGC | Rh, D | [1147-1165] |
| 11 | 1387 | AGAACAAGGCCGACUUGUA | 1966 | UACAAGUCGGCCUUGUUCU | Rh | [1224-1242] |
| 11 | 1388 | GUGGCUUCAUGGUGACUCA | 1967 | UGAGUCACCAUGAAGCCAC | Rh | [894-912] |
| 12 | 1389 | CUCCUGAGACACAUGGGUA | 1968 | UACCCAUGUGUCUCAGGAG | D | [1528-1546] |
| 12 | 1390 | CAGCCUUGGAUACUCCAUA | 1969 | UAUGGAGUAUCCAAGGCUG | Rh | [1576-1594] |
| 12 | 1391 | AAGGCUCCUGAGACACAUA | 1970 | UAUGUGUCUCAGGAGCCUU | D | [1524-1542] |
| 12 | 1392 | AGAAGAAGGCUGUUGCCAA | 1971 | UUGGCAACAGCCUUCUUCU | Rt | [1122-1140] |
| 12 | 1393 | CUACUACGACGACGAGAAA | 1972 | UUUCGUCGUCGUAGUAG | Rb | [961-979] |
| 12 | 1394 | CCUUUGUUGCUAUCAAUCA | 1973 | UGAUUGAUAGCAACAAAGG | Rh | [2119-2137] |
| 12 | 1395 | AGGCAGUGGAGAACAUCCA | 1974 | UGGAUGUUCUCCACUGCCU | Rh | [414-432] |
| 12 | 1396 | CCAUCACGUGGAGCUCUA | 1975 | UAGAGGCUCCACGUGAUGG | Rh | [1045-1063] |
| 12 | 1397 | AGCUCUCCAGCCUCAUCAA | 1976 | UUGAUGAGGCUGGAGAGCU | Rh, D, Rt, | [1017-1035] |
| 12 | 1398 | GGCUCCCUGCUAUUCAUUA | 1977 | UAAUGAAUAGCAGGGAGCC | D | [1421-1439] |
| 13 | 1399 | GGGAACAUGAGCCUUUGUA | 1978 | UACAAAGGCUCAUGUUCCC | Rh | [2108-2126] |
| 13 | 1400 | GGGCCAUAGUCAUUCUGCA | 1979 | UGCAGAAUGACUAUGGCCC | | [1728-1746] |
| 13 | 1401 | CCAAAGAGCAGCUGAAGAA | 1980 | UUCUUCAGCUGCUCUUUGG | Rh, Rb, P | [1086-1104] |
| 13 | 1402 | GACGAGAAGGAAAAGCUGA | 1981 | UCAGCUUUUCCUUCUCGUC | Rh | [971-989] |
| 13 | 1403 | GGGCUUCUGGGCAGACUCA | 1982 | UGAGUCUGCCCAGAAGCCC | Rh | [2000-2018] |
| 13 | 1404 | CAAGGACCAGGCAGUGGAA | 1983 | UUCCACUGCCUGGUCCUUG | Rh | [406-424] |
| 13 | 1405 | CUGUGAGACCAAAUUGAGA | 1984 | UCUCAAUUUGGUCUCACAG | Rh | [1815-1833] |
| 13 | 1406 | GACUGAGGCCAUUGACAAA | 1985 | UUUGUCAAUGGCCUCAGUC | Rh | [1207-1225] |
| 13 | 1407 | GACUUGUCACGCAUGUCAA | 1986 | UUGACAUGCGUGACAAGUC | Rh | [1235-1253] |
| 13 | 1408 | GAGGUGAGGUACCAGCCUA | 1987 | UAGGCUGGUACCUCACCUC | | [1564-1582] |
| 14 | 1409 | CAGAUACCAUGAUGCUGAA | 1988 | UUCAGCAUCAUGGUAUCUG | Rh | [1681-1699] |

TABLE D-continued

SERPINH1 Active 18 + 1-mer siRNAs

| No | SEQ ID | Sense siRNA | SEQ ID | AntiSense siRNA | Other Sp | human- |
|---|---|---|---|---|---|---|
| 14 | 1410 | AGGCAAGAAGGACCUGUAA | 1989 | UUACAGGUCCUUCUUGCCU | Rh, D | [1252-1270] |
| 14 | 1411 | CUGGGAUGAGAAAUUCCAA | 1990 | UUGGAAUUUCUCAUCCCAG | Rh | [856-874] |
| 14 | 1412 | AGGUACCAGCCUUGGAUAA | 1991 | UUAUCCAAGGCUGGUACCU | Rh | [1570-1588] |
| 14 | 1413 | CAGCCAGCCCUCUUCUGAA | 1992 | UUCAGAAGAGGGCUGGCUG | | [1843-1861] |
| 14 | 1414 | GUGUCAUGAUGAUGCACCA | 1993 | UGGUGCAUCAUCAUGACAC | Rh | [927-945] |
| 14 | 1415 | CCUCUACAACUACUACGAA | 1994 | UUCGUAGUAGUUGUAGAG | Rb, D | [952-970] |
| 14 | 1416 | CCGCCGAGGUGAAGAAACA | 1995 | UGUUUCUUCACCUCGGCGG | Rh | [282-300] |
| 14 | 1417 | GCUAUCAAUCCAAGAACUA | 1996 | UAGUUCUUGGAUUGAUAGC | Rh | [2127-2145] |
| 14 | 1418 | AGCCUGCCUCAAUCAGUAA | 1997 | UUACUGAUUGAGGCAGGCU | | [1768-1786] |
| 15 | 1419 | GGUCCGGCCUAAGGGUGAA | 1998 | UUCACCCUUAGGCCGGACC | Rh | [1447-1465] |
| 15 | 1420 | GAAGGAAAAGCUGCAAAUA | 1999 | UAUUUGCAGCUUUUCCUUC | Rh | [976-994] |
| 15 | 1421 | GGCCUCUACAACUACUACA | 2000 | UGUAGUAGUUGUAGAGGCC | Rb, D | [950-968] |
| 15 | 1422 | UGUUCUUCAAGCCACACUA | 2001 | UAGUGUGGCUUGAAGAACA | Rh, Rb, D | [840-858] |
| 15 | 1423 | GGCCAAGGCAGUGCUGAGA | 2002 | UCUCAGCACUGCCUUGGCC | Rh | [505-523] |
| 15 | 1424 | AGAAAUUCCACCACAAGAA | 2003 | UUCUUGUGGUGGAAUUUCU | Rh | [864-882] |
| 15 | 1425 | CUGCAGUCCAUCAACGAGA | 2004 | UCUCGUUGAUGGACUGCAG | Rh, Rt, M | [737-755] |
| 15 | 1426 | CCAGCGUGUUCCACGCCAA | 2005 | UUGGCGUGGAACACGCUGG | | [1275-1293] |
| 15 | 1427 | GCUCCUCCUGCUUCUCAA | 2006 | UUGAGAAGCAGGAGGGAGC | | [234-252] |
| 15 | 1428 | CCGGACAGGCCUCUACAAA | 2007 | UUUGUAGAGGCCUGUCCGG | Rh, Rb, Rt, | [943-961] |
| 16 | 1429 | CCCAUCACGUGGAGCCUCA | 2008 | UGAGGCUCCACGUGAUGGG | Rh | [1044-1062] |
| 16 | 1430 | CCGGCCUAAGGGUGACAAA | 2009 | UUUGUCACCCUUAGGCCGG | Rh | [1450-1468] |
| 16 | 1431 | CCUAUACCGUGGGUGUCAA | 2010 | UUGACACCCACGGUAUAGG | Rh, D, P | [915-933] |
| 16 | 1432 | CAGUGGAGAACAUCCUGGA | 2011 | UCCAGGAUGUUCUCCACUG | Rh | [417-435] |
| 16 | 1433 | CACUGGGAUGAGAAAUUCA | 2012 | UGAAUUUCUCAUCCCAGUG | Rh | [854-872] |
| 16 | 1434 | AUCCAAAGGCUCCUGAGAA | 2013 | UUCUCAGGAGCCUUUGGAU | | [1519-1537] |
| 16 | 1435 | UGAGAAAUUCCACCACAAA | 2014 | UUUGUGGUGGAAUUUCUCA | Rh | [862-880] |
| 16 | 1436 | GGUGGAAAAACAGACCGGA | 2015 | UCCGGUCUGUUUUUCCACC | | [1602-1620] |
| 16 | 1437 | GCUGGGCAGCCGACUGUAA | 2016 | UUACAGUCGGCUGCCCAGC | | [616-634] |
| 16 | 1438 | CCAUAGUCAUUCUGCCUGA | 2017 | UCAGGCAGAAUGACUAUGG | | [1731-1749] |
| 17 | 1439 | GCACCGGACAGGCCUCUAA | 2018 | UUAGAGGCCUGUCCGGUGC | Rh, Rb, Rt, | [940-958] |
| 17 | 1440 | GUUGGACACAGAUGGCAAA | 2019 | UUUGCCAUCUGUGUCCAAC | | [1303-1321] |
| 17 | 1441 | GCCUGCCUCAAUCAGUAUA | 2020 | UAUACUGAUUGAGGCAGGC | | [1769-1787] |
| 17 | 1442 | GAUCAACUUCCGCGACAAA | 2021 | UUUGUCGCGGAAGUUGAUC | D | [709-727] |
| 17 | 1443 | GGCCGCAGUGAGGCGGAUA | 2022 | UAUCCGCCUCACUGCGGCC | | [1962-1980] |
| 17 | 1444 | CUGCGGAGAAGUUGAGCCA | 2023 | UGGCUCAACUUCUCCGCAG | | [324-342] |
| 17 | 1445 | GCAUCCAAAGGCUCCUGAA | 2024 | UUCAGGAGCCUUUGGAUGC | | [1517-1535] |
| 17 | 1446 | GCUUCUGGGCAGACUCUGA | 2025 | UCAGAGUCUGCCCAGAAGC | Rh | [2002-2020] |
| 17 | 1447 | CCAGCCCUCUUCUGACACA | 2026 | UGUGUCAGAAGAGGGCUGG | | [1846-1864] |

TABLE D-continued

SERPINH1 Active 18 + 1-mer siRNAs

| No | SEQ ID | Sense siRNA | SEQ ID | AntiSense siRNA | Other Sp | human- |
|---|---|---|---|---|---|---|
| 17 | 1448 | GCUCUAUCCCAACCUCUCA | 2027 | UGAGAGGUUGGGAUAGAG | Rh | [1888-1906] |
| 18 | 1449 | GGACGUGGAGCGCACGGAA | 2028 | UUCCGUGCGCUCCACGUCC | Rh, D | [799-817] |
| 18 | 1450 | CCAAGGCAGUGCUGAGCGA | 2029 | UCGCUCAGCACUGCCUUGG | Rh | [507-525] |
| 18 | 1451 | GCAGAAGAAGGCUGUUGCA | 2030 | UGCAACAGCCUUCUUCUGC | Rt | [1120-1138] |
| 18 | 1452 | GACAUUUGUUGGAGCGUA | 2031 | UACGCUCCAACAAAAUGUC | | [2183-2201] |
| 18 | 1453 | CGAGCACUCCAAGAUCAAA | 2032 | UUUGAUCUUGGAGUGCUCG | Rh, D | [697-715] |
| 18 | 1454 | UCAUGAUGAUGCACCGGAA | 2033 | UUCCGGUGCAUCAUCAUGA | Rh | [930-948] |
| 18 | 1455 | CCUGCUUCUCAGCGCCUUA | 2034 | UAAGGCGCUGAGAAGCAGG | | [241-259] |
| 18 | 1456 | CCCAACCUCUCCCAACUAA | 2035 | UUAGUUGGGAGAGGUUGG | Rh | [1895-1913] |
| 18 | 1457 | UGGGCAGACUCUGGUCAAA | 2036 | UUUGACCAGAGUCUGCCCA | Rh | [2007-2025] |
| 18 | 1458 | CUCUGGUCAAGAAGCAUCA | 2037 | UGAUGCUUCUUGACCAGAG | Rh | [2015-2033] |
| 19 | 1459 | GAGCCUCUCGAGCGCCUUA | 2038 | UAAGGCGCUCGAGAGGCUC | | [1055-1073] |
| 19 | 1460 | AGAAGGCUGUUGCCAUCUA | 2039 | UAGAUGGCAACAGCCUUCU | Rt | [1125-1143] |
| 19 | 1461 | CCCUGCUAGUCAACGCCAA | 2040 | UUGGCGUUGACUAGCAGGG | Rh | [822-840] |
| 19 | 1462 | GCCUUCAGCUUGUACCAGA | 2041 | UCUGGUACAAGCUGAAGGC | | [380-398] |
| 19 | 1463 | GCUGCUAACCAAAGAGCAA | 2042 | UUGCUCUUUGGUUAGCAGC | | [1078-1096] |
| 19 | 1464 | CCCACAAGCUCUCCAGCCA | 2043 | UGGCUGGAGAGCUUGUGGG | Rh, D, P | [1011-1029] |
| 19 | 1465 | GCUCCCUGCUAUUCAUUGA | 2044 | UCAAUGAAUAGCAGGGAGC | D | [1422-1440] |
| 19 | 1466 | GUUCUUCAAAGAUAGGGAA | 2045 | UUCCCUAUCUUUGAAGAAC | | [2083-2101] |
| 19 | 1467 | GUCAGCCAGCCCUCUUCUA | 2046 | UAGAAGAGGGCUGGCUGAC | Rh | [1841-1859] |
| 19 | 1468 | GCGGGACACCCAAAGCGGA | 2047 | UCCGCUUUGGGUGUCCCGC | | [1405-1423] |
| 20 | 1469 | AGCGCAGCGCGCUGCAGUA | 2048 | UACUGCAGCGCGCUGCGCU | Rh, Rt | [726-744] |
| 20 | 1470 | CCGGAAACUCCACAUCCUA | 2049 | UAGGAUGUGGAGUUUCCGG | | [1701-1719] |
| 20 | 1471 | CCAUUGACAAGAACAAGGA | 2050 | UCCUUGUUCUUGUCAAUGG | Rh, D | [1215-1233] |
| 20 | 1472 | GGACAUCUACGGGCGCGAA | 2051 | UUCGCGCCCGUAGAUGUCC | D | [1333-1351] |
| 20 | 1473 | GACACAUGGGUGCUAUUGA | 2052 | UCAAUAGCACCCAUGUGUC | Rh, Rt, M | [1535-1553] |
| 20 | 1474 | CCUGGCACUGCGGAGAAGA | 2053 | UCUUCUCCGCAGUGCCAGG | | [317-335] |
| 20 | 1475 | GGGCCUGACUGAGGCCAUA | 2054 | UAUGGCCUCAGUCAGGCCC | Rt | [1201-1219] |
| 20 | 1476 | ACACUGGGAUGAGAAAUUA | 2055 | UAAUUUCUCAUCCCAGUGU | Rh | [853-871] |
| 20 | 1477 | GGUCAGCCAGCCCUCUUCA | 2056 | UGAAGAGGGCUGGCUGACC | Rh | [1840-1858] |
| 20 | 1478 | GUGAGGCGGAUUGAGAAGA | 2057 | UCUUCUCAAUCCGCCUCAC | | [1969-1987] |
| 21 | 1479 | UCACCUGUGAGACCAAAUA | 2058 | UAUUUGGUCUCACAGGUGA | Rh | [1811-1829] |
| 21 | 1480 | AGCUGCAAAUCGUGGAGAA | 2059 | UUCUCCACGAUUUGCAGCU | Rh | [984-1002] |
| 21 | 1481 | GGUGCACACAGGAUGGCAA | 2060 | UUGCCAUCCUGUGUGCACC | Rh | [1495-1513] |
| 21 | 1482 | GGGUGUGGUGGAGGUGACA | 2061 | UGUCACCUCCACCACACCC | Rh, D | [1153-1171] |
| 21 | 1483 | CCAGCCUUGGAUACUCCAA | 2062 | UUGGAGUAUCCAAGGCUGG | Rh | [1575-1593] |
| 21 | 1484 | CCACAAGCUCUCCAGCCUA | 2063 | UAGGCUGGAGAGCUUGUGG | Rh, D, P | [1012-1030] |
| 21 | 1485 | AAAGGCUCCUGAGACACAA | 2064 | UUGUGUCUCAGGAGCCUUU | | [1523-1541] |

TABLE D-continued

SERPINH1 Active 18 + 1-mer siRNAs

| No | SEQ ID | Sense siRNA | SEQ ID | AntiSense siRNA | Other Sp | human- |
|---|---|---|---|---|---|---|
| 21 | 1486 | AGGAAAAGCUGCAAAUCGA | 2065 | UCGAUUUGCAGCUUUUCCU | Rh | [978-996] |
| 21 | 1487 | CGCAGCAGCUCCUGGCACA | 2066 | UGUGCCAGGAGCUGCUGCG | | [307-325] |
| 21 | 1488 | GGUGUCAUGAUGAUGCACA | 2067 | UGUGCAUCAUCAUGACACC | Rh | [926-944] |
| 22 | 1489 | CCUCUUCUGACACUAAAAA | 2068 | UUUUUAGUGUCAGAAGAG | | [1851-1869] |
| 22 | 1490 | AGCUAGAAUUCACUCCACA | 2069 | UGUGGAGUGAAUUCUAGCU | Rh | [1649-1667] |
| 22 | 1491 | CGCUGGGCGGCAAGGCAA | 2070 | UUCGCCUUGCCGCCCAGCG | | [474-492] |
| 22 | 1492 | GGCCUGGCCUUCAGCUUGA | 2071 | UCAAGCUGAAGGCCAGGCC | | [374-392] |
| 22 | 1493 | AGACACAUGGGUGCUAUUA | 2072 | UAAUAGCACCCAUGUGUCU | Rh, Rt, M | [1534-1552] |
| 22 | 1494 | CGUGGGUGUCAUGAUGAUA | 2073 | UAUCAUCAUGACACCCACG | Rh | [922-940] |
| 22 | 1495 | GUGGGUGUCAUGAUGAUGA | 2074 | UCAUCAUCAUGACACCCAC | Rh | [923-941] |
| 22 | 1496 | GAGAAGGAGCUCCCAGGAA | 2075 | UUCCUGGGAGCUCCUUCUC | | [1981-1999] |
| 22 | 1497 | GACUCUGGUCAAGAAGCAA | 2076 | UUGCUUCUUGACCAGAGUC | Rh | [2013-2031] |
| 22 | 1498 | CACUAAAACACCUCAGCUA | 2077 | UAGCUGAGGUGUUUUAGU | | [1861-1879] |
| 23 | 1499 | GGAGGCAUCCAAAGGCUCA | 2078 | UGAGCCUUUGGAUGCCUCC | | [1513-1531] |
| 23 | 1500 | GACCCAGCUCAGUGAGCUA | 2079 | UAGCUCACUGAGCUGGGUC | | [636-654] |
| 23 | 1501 | CCAUGACCUGCAGAAACAA | 2080 | UUGUUUCUGCAGGUCAUGG | Rh, Rt, M | [1171-1189] |
| 23 | 1502 | AGAUGCAGAAGAAGGCUGA | 2081 | UCAGCCUUCUUCUGCAUCU | Rh, Rt, M | [1116-1134] |
| 23 | 1503 | CAGCAAGCAGCACUACAAA | 2082 | UUUGUAGUGCUGCUUGCUG | Rh, D | [676-694] |
| 23 | 1504 | CAAGCUCUCCAGCCUCAUA | 2083 | UAUGAGGCUGGAGAGCUUG | Rh, D, M, P | [1015-1033] |
| 23 | 1505 | UGCAGAAGAAGGCUGUUGA | 2084 | UCAACAGCCUUCUUCUGCA | Rt | [1119-1137] |
| 23 | 1506 | GGCGCGAGGAGCUGCGCAA | 2085 | UUGCGCAGCUCCUCGCGCC | Rh, D, M | [1344-1362] |
| 23 | 1507 | GGUACCAGCCUUGGAUACA | 2086 | UGUAUCCAAGGCUGGUACC | Rh | [1571-1589] |
| 23 | 1508 | GCAGCCGACUGUACGGACA | 2087 | UGUCCGUACAGUCGGCUGC | | [621-639] |
| 24 | 1509 | CAGCCUCAUCAUCCUCAUA | 2088 | UAUGAGGAUGAUGAGGCU | Rh, D, Rt, | [1024-1042] |
| 24 | 1510 | GCCACCGCCUUUGAGUUGA | 2089 | UCAACUCAAAGGCGGUGGC | Rh | [1289-1307] |
| 24 | 1511 | AGAAGGACCUGUACCUGGA | 2090 | UCCAGGUACAGGUCCUUCU | Rh, D | [1257-1275] |
| 24 | 1512 | GGUGAAGAAACCUGCAGCA | 2091 | UGCUGCAGGUUUCUUCACC | Rh | [289-307] |
| 24 | 1513 | GUACCUUCUCACCUGUGAA | 2092 | UUCACAGGUGAGAAGGUAC | Rh | [1803-1821] |
| 24 | 1514 | GGCCAAGGACCAGGCAGUA | 2093 | UACUGCCUGGUCCUUGGCC | Rh | [403-421] |
| 24 | 1515 | GGCGGCAAGGCGACCACGA | 2094 | UCGUGGUCGCCUUGCCGCC | | [479-497] |
| 24 | 1516 | AGCACUCCAAGAUCAACUA | 2095 | UAGUUGAUCUUGGAGUGCU | Rh, D | [699-717] |
| 24 | 1517 | AUAUUUAUAGCCAGGUACA | 2096 | UGUACCUGGCUAUAAAUAU | Rh | [1789-1807] |
| 24 | 1518 | GGCAGCCGACUGUACGGAA | 2097 | UUCCGUACAGUCGGCUGCC | | [620-638] |
| 25 | 1519 | GUCACGCAUGUCAGGCAAA | 2098 | UUUGCCUGACAUGCGUGAC | Rh, D | [1240-1258] |
| 25 | 1520 | GACAGGCCUCUACAACUAA | 2099 | UUAGUUGUAGAGGCCUGUC | Rh, Rb, Rt, | [946-964] |
| 25 | 1521 | GAUGCAGAAGAAGGCUGUA | 2100 | UACAGCCUUCUUCUGCAUC | Rh, Rt, M | [1117-1135] |
| 25 | 1522 | ACCCAUGACCUGCAGAAAA | 2101 | UUUUCUGCAGGUCAUGGGU | Rh, Rt, M | [1169-1187] |
| 25 | 1523 | GGCUUCAUGGUGACUCGGA | 2102 | UCCGAGUCACCAUGAAGCC | Rh | [896-914] |

TABLE D-continued

SERPINH1 Active 18 + 1-mer siRNAs

| No | SEQ ID | Sense siRNA | SEQ ID | AntiSense siRNA | Other Sp | human- |
|---|---|---|---|---|---|---|
| 25 | 1524 | UGCCUCAAUCAGUAUUCAA | 2103 | UUGAAUACUGAUUGAGGCA | | [1772-1790] |
| 25 | 1525 | GUUCUUCAAGCCACACUGA | 2104 | UCAGUGUGGCUUGAAGAAC | Rh, Rb, D | [841-859] |
| 25 | 1526 | ACUCCAAGAUCAACUUCCA | 2105 | UGGAAGUUGAUCUUGGAG | Rh, D, Rt, | [702-720] |
| 25 | 1527 | GCUGUUCUACGCCGACCAA | 2106 | UUGGUCGGCGUAGAACAGC | Rh | [1369-1387] |
| 25 | 1528 | UAGUCAACGCCAUGUUCUA | 2107 | UAGAACAUGGCGUUGACUA | Rh | [828-846] |
| 26 | 1529 | CCGUGUGCCUGAGCGGACA | 2108 | UGUCCGCUCAGGCACACGG | Rh | [1625-1643] |
| 26 | 1530 | AGGCCUCUACAACUACUAA | 2109 | UUAGUAGUUGUAGAGGCCU | Rh, Rb, D, | [949-967] |
| 26 | 1531 | GCUUCAUGGUGACUCGGUA | 2110 | UACCGAGUCACCAUGAAGC | Rh | [897-915] |
| 26 | 1532 | GGUCAAGAAGCAUCGUGUA | 2111 | UACACGAUGCUUCUUGACC | Rh | [2019-2037] |
| 26 | 1533 | CUGCGAGCACUCCAAGAUA | 2112 | UAUCUUGGAGUGCUCGCAG | Rh, D | [694-712] |
| 26 | 1534 | GUCCUAUACCGUGGGUGUA | 2113 | UACACCCACGGUAUAGGAC | Rh | [913-931] |
| 26 | 1535 | GGCCUGACUGAGGCCAUUA | 2114 | UAAUGGCCUCAGUCAGGCC | Rh | [1202-1220] |
| 26 | 1536 | CACUCCAAGAUCAACUUCA | 2115 | UGAAGUUGAUCUUGGAGU | Rh, D, Rt, | [701-719] |
| 26 | 1537 | GCGUCGCAGGCCAAGGCAA | 2116 | UUGCCUUGGCCUGCGACGC | | [497-515] |
| 26 | 1538 | AAGGGUGACAAGAUGCGAA | 2117 | UUCGCAUCUUGUCACCCUU | Rh, D | [1457-1475] |
| 27 | 1539 | CAAGCUGUUCUACGCCGAA | 2118 | UUCGGCGUAGAACAGCUUG | Rh | [1366-1384] |
| 27 | 1540 | CCUGCUAGUCAACGCCAUA | 2119 | UAUGGCGUUGACUAGCAGG | Rh | [823-841] |
| 27 | 1541 | CCAAGGGUGUGGUGGAGGA | 2120 | UCCUCCACCACACCCUUGG | Rh, D | [1149-1167] |
| 27 | 1542 | CACACAGGAUGGCAGGAGA | 2121 | UCUCCUGCCAUCCUGUGUG | Rh | [1499-1517] |
| 27 | 1543 | UCCUGAGACACAUGGGUGA | 2122 | UCACCCAUGUGUCUCAGGA | D, Rt, M | [1529-1547] |
| 27 | 1544 | CUACAACUACUACGACGAA | 2123 | UUCGUCGUAGUAGUUGUAG | Rb | [955-973] |
| 27 | 1545 | GACAAGAUGCGAGACGAGA | 2124 | UCUCGUCUCGCAUCUUGUC | Rh, Rt | [1463-1481] |
| 27 | 1546 | CCUGGAAGCUGGGCAGCCA | 2125 | UGGCUGCCCAGCUUCCAGG | | [609-627] |
| 27 | 1547 | CUUCAAGCCACACUGGGAA | 2126 | UUCCCAGUGUGGCUUGAAG | Rh, Rb, D | [844-862] |
| 27 | 1548 | GCGAGACGAGUUAUAGGGA | 2127 | UCCCUAUAACUCGUCUCGC | Rh | [1471-1489] |
| 28 | 1549 | GAAGCUGGGCAGCCGACUA | 2128 | UAGUCGGCUGCCCAGCUUC | | [613-631] |
| 28 | 1550 | GUGCCUGAGCGGACCUUCA | 7129 | UGAAGGUCCGCUCAGGCAC | Rh | [1629-1647] |
| 28 | 1551 | GGUGACCCAUGACCUGCAA | 2130 | UUGCAGGUCAUGGGUCACC | Rh, Rt, M | [1165-1183] |
| 28 | 1552 | AUGAGCCUUUGUUGCUAUA | 2131 | UAUAGCAACAAAGGCUCAU | Rh | [2114-2132] |
| 28 | 1553 | CAACUACUACGACGACGAA | 2132 | UUCGUCGUCGUAGUAGUUG | Rb | [958-976] |
| 28 | 1554 | GCUGCGCUCACUCAGCAAA | 2133 | UUUGCUGAGUGAGCGCAGC | Rh | [571-589] |
| 28 | 1555 | GAGAACAUCCUGGUGUCAA | 2134 | UUGACACCAGGAUGUUCUC | | [422-440] |
| 28 | 1556 | CCCAAGCUGUUCUACGCCA | 2135 | UGGCGUAGAACAGCUUGGG | Rh | [1364-1382] |
| 28 | 1557 | CAGCUCUAUCCCAACCUCA | 2136 | UGAGGUUGGGAUAGAGCU | | [1886-1904] |
| 28 | 1558 | UGAGCUUCGCUGAUGACUA | 2137 | UAGUCAUCAGCGAAGCUCA | Rh | [648-666] |
| 29 | 1559 | CCCAAGGCGGCCACGCUUA | 2138 | UAAGCGUGGCCGCCUUGGG | Rh | [341-359] |
| 29 | 1560 | CUAUACCGUGGGUGUCAUA | 2139 | UAUGACACCCACGGUAUAG | Rh | [916-934] |
| 29 | 1561 | CAUUGACAAGAACAAGGCA | 2140 | UGCCUUGUUCUUGUCAAUG | Rh, D | [1216-1234] |

TABLE D-continued

SERPINH1 Active 18 + 1-mer siRNAs

| No | SEQ ID | Sense siRNA | SEQ ID | AntiSense siRNA | Other Sp | human- |
|---|---|---|---|---|---|---|
| 29 | 1562 | GGACCCAGCUCAGUGAGCA | 2141 | UGCUCACUGAGCUGGGUCC | | [635-653] |
| 29 | 1563 | GACGACGAGAAGGAAAAGA | 2142 | UCUUUUCCUUCUCGUCGUC | Rh | [968-986] |
| 29 | 1564 | GCGGCAAGGCGACCACGGA | 2143 | UCCGUGGUCGCCUUGCCGC | | [480-498] |
| 29 | 1565 | GGGACACCCAAAGCGGCUA | 2144 | UAGCCGCUUUGGGUGUCCC | | [1407-1425] |
| 29 | 1566 | GGGAGGUGAGGUACCAGCA | 2145 | UGCUGGUACCUCACCUCCC | | [1562-1580] |
| 29 | 1567 | GCAGCACUACAACUGCGAA | 2146 | UUCGCAGUUGUAGUGCUGC | Rh, D | [682-700] |
| 29 | 1568 | GCGCAACGUGACCUGGAAA | 2147 | UUUCCAGGUCACGUUGCGC | M | [598-616] |
| 30 | 1569 | GGGCUGGGCCUGACUGAGA | 2148 | UCUCAGUCAGGCCCAGCCC | | [1196-1214] |
| 30 | 1570 | CCUGAGCGGACCUUCCCAA | 2149 | UUGGGAAGGUCCGCUCAGG | Rh | [1632-1650] |
| 30 | 1571 | GCAGCUGAAGAUCUGGAUA | 2150 | UAUCCAGAUCUUCAGCUGC | Rh, D | [1093-1111] |
| 30 | 1572 | AGUGGAGAACAUCCUGGUA | 2151 | UACCAGGAUGUUCUCCACU | Rh | [418-436] |
| 30 | 1573 | GCAAGCAGCACUACAACUA | 2152 | UAGUUGUAGUGCUGCUUGC | Rh, D | [678-696] |
| 30 | 1574 | AGCUCAGUGAGCUUCGCUA | 2153 | UAGCGAAGCUCACUGAGCU | | [641-659] |
| 30 | 1575 | CCGACUUGUCACGCAUGUA | 2154 | UACAUGCGUGACAAGUCGG | Rh | [1233-1251] |
| 30 | 1576 | CCGAGGUCACCAAGGACGA | 2155 | UCGUCCUUGGUGACCUCGG | Rh, D | [786-804] |
| 30 | 1577 | GGAGCCUCUCGAGCGCCUA | 2156 | UAGGCGCUCGAGAGGCUCC | | [1054-1072] |
| 30 | 1578 | GGCCGCGCAGACCACCGAA | 2157 | UUCGGUGGUCUGCGCGGCC | | [757-775] |
| 31 | 1579 | GGAAACUCCACAUCCUGUA | 2158 | UACAGGAUGUGGAGUUUCC | Rh | [1703-1721] |
| 31 | 1580 | CAAAGCGGCUCCCUGCUAA | 2159 | UUAGCAGGGAGCCGCUUUG | | [1415-1433] |
| 31 | 1581 | GCUCCUGAGACACAUGGGA | 2160 | UCCCAUGUGUCUCAGGAGC | D | [1527-1545] |
| 31 | 1582 | CCUGGGCCAUAGUCAUUCA | 2161 | UGAAUGACUAUGGCCCAGG | | [1725-1743] |
| 31 | 1583 | CGUGGAGCCUCUCGAGCGA | 2162 | UCGCUCGAGAGGCUCCACG | | [1051-1069] |
| 31 | 1584 | CCUCCUGCUUCUCAGCGCA | 2163 | UGCGCUGAGAAGCAGGAGG | | [238-256] |
| 31 | 1585 | AGUCCCAGAUCAAGCCUGA | 2164 | UCAGGCUUGAUCUGGGACU | Rh | [1756-1774] |
| 31 | 1586 | UACCGUGGGUGUCAUGAUA | 2165 | UAUCAUGACACCCACGGUA | Rh | [919-937] |
| 31 | 1587 | GCCAGCCCUCUUCUGACAA | 2166 | UUGUCAGAAGAGGGCUGGC | | [1845-1863] |
| 31 | 1588 | CCGAGGUGAAGAAACCUGA | 2167 | UCAGGUUUCUUCACCUCGG | Rh, Rt | [285-303] |
| 32 | 1589 | UCCUGGCACUGCGGAGAAA | 2168 | UUUCUCCGCAGUGCCAGGA | | [316-334] |
| 32 | 1590 | CCCGGAAACUCCACAUCCA | 2169 | UGGAUGUGGAGUUUCCGGG | | [1700-1718] |
| 32 | 1591 | ACUCUGGUCAAGAAGCAUA | 2170 | UAUGCUUCUUGACCAGAGU | Rh | [2014-2032] |
| 32 | 1592 | CCCAGAUACCAUGAUGCUA | 2171 | UAGCAUCAUGGUAUCUGGG | Rh | [1679-1697] |
| 32 | 1593 | CCUGAGACACAUGGGUGCA | 2172 | UGCACCCAUGUGUCUCAGG | D, Rt, M | [1530-1548] |
| 32 | 1594 | GCACUACAACUGCGAGCAA | 2173 | UUGCUCGCAGUUGUAGUGC | Rh, D | [685-703] |
| 32 | 1595 | CCACAAGAUGGUGGACAAA | 2174 | UUUGUCCACCAUCUUGUGG | Rh, Rb, M, | [874-892] |
| 32 | 1596 | GGACACAGAUGGCAACCCA | 2175 | UGGGUUGCCAUCUGUGUCC | | [1306-1324] |
| 32 | 1597 | GAAAAGCUGCUAACCAAAA | 2176 | UUUUGGUUAGCAGCUUUUC | | [1073-1091] |
| 32 | 1598 | ACUACAACUGCGAGCACUA | 2177 | UAGUGCUCGCAGUUGUAGU | Rh, D | [687-705] |
| 33 | 1599 | GCACUCCAAGAUCAACUUA | 2178 | UAAGUUGAUCUUGGAGUGC | Rh, D | [700-718] |

TABLE D-continued

SERPINH1 Active 18 + 1-mer siRNAs

| No | SEQ ID | Sense siRNA | SEQ ID | AntiSense siRNA | Other Sp | human- |
|---|---|---|---|---|---|---|
| 33 | 1600 | GCCUUGAAAAGCUGCUAAA | 2179 | UUUAGCAGCUUUUCAAGGC | | [1068-1086] |
| 33 | 1601 | GUGACUCGGUCCUAUACCA | 2180 | UGGUAUAGGACCGAGUCAC | Rh | [905-923] |
| 33 | 1602 | GUGGUGGAGGUGACCCAUA | 2181 | UAUGGGUCACCUCCACCAC | Rh, Rb, Rt, | [1157-1175] |
| 33 | 1603 | AUGCGAGACGAGUUAUAGA | 2182 | UCUAUAACUCGUCUCGCAU | Rh | [1469-1487] |
| 33 | 1604 | ACCUUCCCAGCUAGAAUUA | 2183 | UAAUUCUAGCUGGGAAGGU | Rh | [1641-1659] |
| 33 | 1605 | CCCAGCUAGAAUUCACUCA | 2184 | UGAGUGAAUUCUAGCUGGG | Rh | [1646-1664] |
| 33 | 1606 | GGUCACCAAGGACGUGGAA | 2185 | UUCCACGUCCUUGGUGACC | Rh, D | [790-808] |
| 33 | 1607 | GGCCUCAGGGUGCACACAA | 2186 | UUGUGUGCACCCUGAGGCC | | [1487-1505] |
| 33 | 1608 | UGAGGUACCAGCCUUGGAA | 2187 | UUCCAAGGCUGGUACCUCA | Rh | [1568-1586] |
| 34 | 1609 | CAUGGUGACUCGGUCCUAA | 2188 | UUAGGACCGAGUCACCAUG | Rh | [901-919] |
| 34 | 1610 | GGUGAGGUACCAGCCUUGA | 2189 | UCAAGGCUGGUACCUCACC | Rh | [1566-1584] |
| 34 | 1611 | GCCGAGGUGAAGAAACCUA | 2190 | UAGGUUUCUUCACCUCGGC | Rh, Rt | [284-302] |
| 34 | 1612 | GUACGGACCCAGCUCAGUA | 2191 | UACUGAGCUGGGUCCGUAC | | [631-649] |
| 34 | 1613 | CAAGAAGGACCUGUACCUA | 2192 | UAGGUACAGGUCCUUCUUG | Rh, D, M | [1255-1273] |
| 34 | 1614 | GAGCACUCCAAGAUCAACA | 2193 | UGUUGAUCUUGGAGUGCUC | Rh, D | [698-716] |
| 34 | 1615 | CAUGUUCUUCAAGCCACAA | 2194 | UUGUGGCUUGAAGAACAUG | Rh, Rb, D | [838-856] |
| 34 | 1616 | CCCUCCUGCUUCUCAGCGA | 2195 | UCGCUGAGAAGCAGGAGGG | | [237-255] |
| 34 | 1617 | AUGUCAGGCAAGAAGGACA | 2196 | UGUCCUUCUUGCCUGACAU | Rh, D | [1247-1265] |
| 34 | 1618 | CAAGAUCAACUUCCGCGAA | 2197 | UUCGCGGAAGUUGAUCUUG | D | [706-724] |
| 35 | 1619 | GCGUGUUCCACGCCACCGA | 2198 | UCGGUGGCGUGGAACACGC | | [1278-1296] |
| 35 | 1620 | CGGACCCAGCUCAGUGAGA | 2199 | UCUCACUGAGCUGGGUCCG | | [634-652] |
| 35 | 1621 | CCUUCAGCUUGUACCAGGA | 2200 | UCCUGGUACAAGCUGAAGG | | [381-399] |
| 35 | 1622 | GCUCUCCAGCCUCAUCAUA | 2201 | UAUGAUGAGGCUGGAGAGC | Rh, D, Rt, | [1018-1036] |
| 35 | 1623 | CCCUGGCCCACAAGCUCUA | 2202 | UAGAGCUUGUGGGCCAGGG | Rh, D, P | [1005-1023] |
| 35 | 1624 | GCCCGAGGUCACCAAGGAA | 2203 | UUCCUUGGUGACCUCGGGC | Rh, D | [784-802] |
| 35 | 1625 | GUGGAGAACAUCCUGGUGA | 2204 | UCACCAGGAUGUUCUCCAC | Rh | [419-437] |
| 35 | 1626 | GCUCACUCAGCAACUCCAA | 2205 | UUGGAGUUGCUGAGUGAGC | Rh | [576-594] |
| 35 | 1627 | ACGCCAUGUUCUUCAAGCA | 2206 | UGCUUGAAGAACAUGGCGU | Rh, Rb, P | [834-852] |
| 35 | 1628 | ACACAUGGGUGCUAUUGGA | 2907 | UCCAAUAGCACCCAUGUGU | Rh | [1536-1554] |
| 36 | 1629 | CCAGCUCAGUGAGCUUCGA | 2208 | UCGAAGCUCACUGAGCUGG | | [639-657] |
| 36 | 1630 | CCCAGCUCAGUGAGCUUCA | 2209 | UGAAGCUCACUGAGCUGGG | | [638-656] |
| 36 | 1631 | GGGCGGCAAGGCGACCACA | 2210 | UGUGGUCGCCUUGCCGCCC | | [478-496] |
| 36 | 1632 | CAGGGUGCACACAGGAUGA | 2211 | UCAUCCUGUGUGCACCCUG | | [1492-1510] |
| 36 | 1633 | AGGUGAAGAAACCUGCAGA | 2212 | UCUGCAGGUUUCUUCACCU | Rh | [288-306] |
| 36 | 1634 | CCUCUCCCAACUAUAAAAA | 2213 | UUUUUAUAGUUGGGAGAG | Rh | [1900-1918] |
| 36 | 1635 | GACUGUACGGACCCAGCUA | 2214 | UAGCUGGGUCCGUACAGUC | | [627-645] |
| 36 | 1636 | GAAGGAGCUCCCAGGAGGA | 2215 | UCCUCCGGGAGCUCCUUC | | [1983-2001] |
| 36 | 1637 | ACGCAUGUCAGGCAAGAAA | 2216 | UUUCUUGCCUGACAUGCGU | Rh, D | [1243-1261] |

TABLE D-continued

SERPINH1 Active 18 + 1-mer siRNAs

| No | SEQ ID | Sense siRNA | SEQ ID | AntiSense siRNA | Other Sp | human- |
|---|---|---|---|---|---|---|
| 36 | 1638 | GACUCGGUCCUAUACCGUA | 2217 | UACGGUAUAGGACCGAGUC | Rh | [907-925] |
| 37 | 1639 | CACUACAACUGCGAGCACA | 2218 | UGUGCUCGCAGUUGUAGUG | Rh, D | [686-704] |
| 37 | 1640 | AGCUCCUGGCACUGCGGAA | 2219 | UUCCGCAGUGCCAGGAGCU | | [313-331] |
| 37 | 1641 | CUAAGGGUGACAAGAUGCA | 2220 | UGCAUCUUGUCACCCUUAG | Rh | [1455-1473] |
| 37 | 1642 | UGUGAGACCAAAUUGAGCA | 2221 | UGCUCAAUUUGGUCUCACA | Rh | [1816-1834] |
| 37 | 1643 | GCCGACUUGUCACGCAUGA | 2222 | UCAUGCGUGACAAGUCGGC | Rh | [1232-1250] |
| 37 | 1644 | CAGGAUGGCAGGAGGCAUA | 2223 | UAUGCCUCCUGCCAUCCUG | | [1503-1521] |
| 37 | 1645 | ACAAGAACAAGGCCGACUA | 2224 | UAGUCGGCCUUGUUCUUGU | Rh | [1221-1239] |
| 37 | 1646 | UGCGCUCCCUCCUGCUUCA | 2225 | UGAAGCAGGAGGGAGCGCA | | [231-249] |
| 37 | 1647 | GGCGAGCUGCUGCGCUCAA | 2226 | UUGAGCGCAGCAGCUCGCC | Rh | [563-581] |
| 37 | 1648 | GAUGCACCGGACAGGCCUA | 2227 | UAGGCCUGUCCGGUGCAUC | Rh, Rb, Rt, | [937-955] |
| 38 | 1649 | CGUGUCGCUGGGCGGCAAA | 2228 | UUUGCCGCCCAGCGACACG | | [469-487] |
| 38 | 1650 | AUCCCAACCUCUCCCAACA | 2229 | UGUUGGGAGAGGUUGGGA | Rh | [1893-1911] |
| 38 | 1651 | UGUUCUACGCCGACCACCA | 2230 | UGGUGGUCGGCGUAGAACA | Rh | [1371-1389] |
| 38 | 1652 | CGGCCUGGCCUUCAGCUUA | 2231 | UAAGCUGAAGGCCAGGCCG | | [373-391] |
| 38 | 1653 | GUCGCAGGCCAAGGCAGUA | 2232 | UACUGCCUUGGCCUGCGAC | | [499-517] |
| 38 | 1654 | AGUCAUUCUGCCUGCCCUA | 2233 | UAGGGCAGGCAGAAUGACU | | [1735-1753] |
| 38 | 1655 | CCCAGAAUGACCUGGCCGA | 2234 | UCGGCCAGGUCAUUCUGGG | | [1949-1967] |
| 38 | 1656 | ACAAGAUGGUGGACAACCA | 2235 | UGGUUGUCCACCAUCUUGU | Rh, Rb, M, | [876-894] |
| 38 | 1657 | GCUAGUCAACGCCAUGUUA | 2236 | UAACAUGGCGUUGACUAGC | Rh | [826-844] |
| 38 | 1658 | ACGCCACCGCCUUUGAGUA | 2237 | UACUCAAAGGCGGUGGCGU | Rh | [1287-1305] |
| 39 | 1659 | GCCGCGCAGACCACCGACA | 2238 | UGUCGGUGGUCUGCGCGGC | | [758-776] |
| 39 | 1660 | GCUAUUCAUUGGGCGCCUA | 2239 | UAGGCGCCCAAUGAAUAGC | D | [1429-1447] |
| 39 | 1661 | CUCAGUGAGCUUCGCUGAA | 2240 | UUCAGCGAAGCUCACUGAG | | [643-661] |
| 39 | 1662 | GGAGGUGAGGUACCAGCCA | 2241 | UGGCUGGUACCUCACCUCC | | [1563-1581] |
| 39 | 1663 | GCCAAGGCAGUGCUGAGCA | 2242 | UGCUCAGCACUGCCUUGGC | Rh | [506-524] |
| 39 | 1664 | CUCUCCAGCCUCAUCAUCA | 2243 | UGAUGAUGAGGCUGGAGA | Rh, D, Rt, | [1019-1037] |
| 39 | 1665 | GAAUGACCUGGCCGCAGUA | 2244 | UACUGCGGCCAGGUCAUUC | | [1953-1971] |
| 39 | 1666 | UGGUGACUCGGUCCUAUAA | 2245 | UUAUAGGACCGAGUCACCA | Rh | [903-921] |
| 39 | 1667 | CAGGUACCUUCUCACCUGA | 2246 | UCAGGUGAGAAGGUACCUG | Rh | [1800-1818] |
| 39 | 1668 | GUUCACGCCACCGCCUUA | 2247 | UAAGGCGGUGGCGUGGAAC | D | [1282-1300] |
| 40 | 1669 | CCGACUGUACGGACCCAGA | 2248 | UCUGGGUCCGUACAGUCGG | | [625-643] |
| 40 | 1670 | GCAGACCACCGACGGCAAA | 2249 | UUUGCCGUCGGUGGUCUGC | D, Rt | [763-781] |
| 40 | 1671 | AAGAUGCGAGACGAGUUAA | 2250 | UUAACUCGUCUCGCAUCUU | Rh | [1466-1484] |
| 40 | 1672 | CAAAGAGCAGCUGAAGAUA | 2251 | UAUCUUCAGCUGCUCUUUG | Rh | [1087-1105] |
| 40 | 1673 | ACGACGAGAAGGAAAAGCA | 2252 | UGCUUUUCCUUCUCGUCGU | Rh | [969-987] |
| 40 | 1674 | CACUCCACUUGGACAUGGA | 2253 | UCCAUGUCCAAGUGGAGUG | Rh | [1659-1677] |
| 40 | 1675 | AGUCCAUCAACGAGUGGGA | 2254 | UCCCACUCGUUGAUGGACU | Rh, Rt, M | [741-759] |

TABLE D-continued

SERPINH1 Active 18 + 1-mer siRNAs

| No | SEQ ID | Sense siRNA | SEQ ID | AntiSense siRNA | Other Sp | human- |
|---|---|---|---|---|---|---|
| 40 | 1676 | GCGCCGGCCUGGCCUUCAA | 2255 | UUGAAGGCCAGGCCGGCGC | Rh | [369-387] |
| 40 | 1677 | GGAAAAGCUGCAAAUCGUA | 2256 | UACGAUUUGCAGCUUUUCC | Rh | [979-997] |
| 40 | 1678 | ACAUUUGUUGGAGCGUGA | 2257 | UCACGCUCCAACAAAAUGU | | [2184-2202] |
| 41 | 1679 | ACCGUGGCUUCAUGGUGAA | 2258 | UUCACCAUGAAGCCACGGU | Rh, Rt, M | [891-909] |
| 41 | 1680 | CCCUUCAUCUUCCUAGUGA | 2259 | UCACUAGGAAGAUGAAGGG | | [1388-1406] |
| 41 | 1681 | GAAAUUCCACCACAAGAUA | 2260 | UAUCUUGUGGUGGAAUUUC | Rh | [865-883] |
| 41 | 1682 | CUAUAAAACUAGGUGCUGA | 2261 | UCAGCACCUAGUUUUAUAG | Rh | [1910-1928] |
| 41 | 1683 | GGAGGUGCACGCCGGCCUA | 2262 | UAGGCCGGCGUGCACCUCC | | [544-562] |
| 41 | 1684 | GCAGGCCAAGGCAGUGCUA | 2263 | UAGCACUGCCUUGGCCUGC | | [502-520] |
| 41 | 1685 | UGAGACCAAAUUGAGCUAA | 2264 | UUAGCUCAAUUUGGUCUCA | Rh | [1818-1836] |
| 41 | 1686 | GCCAUAGUCAUUCUGCCUA | 2265 | UAGGCAGAAUGACUAUGGC | | [1730-1748] |
| 41 | 1687 | AGCUGAAGAUCUGGAUGGA | 2266 | UCCAUCCAGAUCUUCAGCU | Rh, D | [1095-1113] |
| 41 | 1688 | CCAUCUCCUUGCCCAAGGA | 2267 | UCCUUGGGCAAGGAGAUGG | Rh | [1137-1155] |
| 42 | 1689 | CCCAGAUCAAGCCUGCCUA | 2268 | UAGGCAGGCUUGAUCUGGG | Rh | [1759-1777] |
| 42 | 1690 | GCUGUUGCCAUCUCCUUGA | 2269 | UCAAGGAGAUGGCAACAGC | | [1130-1148] |
| 42 | 1691 | CGAGGUCACCAAGGACGUA | 2270 | UACGUCCUUGGUGACCUCG | Rh, D | [787-805] |
| 42 | 1692 | CAACUAUAAAACUAGGUGA | 2271 | UCACCUAGUUUUAUAGUUG | Rh | [1907-1925] |
| 42 | 1693 | GAAGGCUGUUGCCAUCUCA | 2272 | UGAGAUGGCAACAGCCUUC | Rt | [1126-1144] |
| 42 | 1694 | UGCGGAGAAGUUGAGCCCA | 2273 | UGGGCUCAACUUCUCCGCA | | [325-343] |
| 42 | 1695 | CUCCUUGCCCAAGGGUGUA | 2274 | UACACCCUUGGGCAAGGAG | Rh | [1141-1159] |
| 42 | 1696 | GCCCUGAAAGUCCCAGAUA | 2275 | UAUCUGGGACUUUCAGGGC | | [1748-1766] |
| 42 | 1697 | CAAGGGUGUGGUGGAGGUA | 2276 | UACCUCCACCACACCCUUG | Rh, D | [1150-1168] |
| 42 | 1698 | AAGAGCAGCUGAAGAUCUA | 2277 | UAGAUCUUCAGCUGCUCUU | Rh | [1089-1107] |
| 43 | 1699 | GAAGAUGCAGAAGAAGGCA | 2278 | UGCCUUCUUCUGCAUCUUC | Rh, Rb, Rt | [1114-1132] |
| 43 | 1700 | CGGAAACUCCACAUCCUGA | 2279 | UCAGGAUGUGGAGUUUCCG | | [1702-1720] |
| 43 | 1701 | AGUCAACGCCAUGUUCUUA | 2280 | UAAGAACAUGGCGUUGACU | Rh | [829-847] |
| 43 | 1702 | CGAGCGCCUUGAAAAGCUA | 2281 | UAGCUUUUCAAGGCGCUCG | | [1063-1081] |
| 43 | 1703 | AUACCGUGGGUGUCAUGAA | 2282 | UUCAUGACACCCACGGUAU | Rh | [918-936] |
| 43 | 1704 | GACCUGGGCAUAGUCAUA | 2283 | UAUGACUAUGGCCCAGGUC | | [1723-1741] |
| 43 | 1705 | CAUGUCAGGCAAGAAGGAA | 2284 | UUCCUUCUUGCCUGACAUG | Rh, D | [1246-1264] |
| 43 | 1706 | UGCGAGACGAGUUAUAGGA | 2285 | UCCUAUAACUCGUCUCGCA | Rh | [1470-1488] |
| 43 | 1707 | CGCAACGUGACCUGGAAGA | 2286 | UCUUCCAGGUCACGUUGCG | | [599-617] |
| 43 | 1708 | AGCAAGCAGCACUACAACA | 2287 | UGUUGUAGUGCUGCUUGCU | Rh, D | [677-695] |
| 44 | 1709 | GCUGCUGCGCUCACUCAGA | 2288 | UCUGAGUGAGCGCAGCAGC | Rh | [568-586] |
| 44 | 1710 | UGAUGAUGCACCGGACAGA | 2289 | UCUGUCCGGUGCAUCAUCA | Rh | [933-951] |
| 44 | 1711 | UUGUUGCUAUCAAUCCAAA | 2290 | UUUGGAUUGAUAGCAACAA | | [2122-2140] |
| 44 | 1712 | CCUUGAAAAGCUGCUAACA | 2291 | UGUUAGCAGCUUUUCAAGG | | [1069-1087] |
| 44 | 1713 | CCCUUUGACCAGGACAUCA | 2292 | UGAUGUCCUGGUCAAAGGG | Rh, Rt | [1322-1340] |

TABLE D-continued

SERPINH1 Active 18 + 1-mer siRNAs

| No | SEQ ID | Sense siRNA | SEQ ID | AntiSense siRNA | Other Sp | human- |
|---|---|---|---|---|---|---|
| 44 | 1714 | GAGGUGAAGAAACCUGCAA | 2293 | UUGCAGGUUUCUUCACCUC | Rh | [287-305] |
| 44 | 1715 | CCCAAGGGUGUGGUGGAGA | 2294 | UCUCCACCACACCCUUGGG | Rh, D | [1148-1166] |
| 44 | 1716 | CCCUGCUAUUCAUUGGGCA | 2295 | UGCCCAAUGAAUAGCAGGG | D | [1425-1443] |
| 44 | 1717 | CUGAAAGUCCCAGAUCAAA | 2296 | UUUGAUCUGGGACUUUCAG | | [1751-1769] |
| 44 | 1718 | GCUGCAAAUCGUGGAGAUA | 2297 | UAUCUCCACGAUUUGCAGC | Rh | [985-1003] |
| 45 | 1719 | CAAGCCUGCCUCAAUCAGA | 2298 | UCUGAUUGAGGCAGGCUUG | Rh | [1766-1784] |
| 45 | 1720 | CGAGCAGCUGCGCGACGAA | 2299 | UUCGUCGCGCAGCUGCUCG | | [526-544] |
| 45 | 1721 | AGGCCGACUUGUCACGCAA | 2300 | UUGCGUGACAAGUCGGCCU | Rh | [1230-1248] |
| 45 | 1722 | GCAGCAGCUCCUGGCACUA | 2301 | UAGUGCCAGGAGCUGCUGC | | [308-326] |
| 45 | 1723 | GGCCAUAGUCAUUCUGCCA | 2302 | UGGCAGAAUGACUAUGGCC | | [1729-1747] |
| 45 | 1724 | CCCGUGUGCCUGAGCGGAA | 2303 | UUCCGCUCAGGCACACGGG | Rh | [1624-1642] |
| 45 | 1725 | CAGCUGAAGAUCUGGAUGA | 2304 | UCAUCCAGAUCUUCAGCUG | Rh, D | [1094-1112] |
| 45 | 1726 | CAAGCCACACUGGGAUGAA | 2305 | UUCAUCCCAGUGUGGCUUG | Rh, Rb | [847-865] |
| 45 | 1727 | GAAUUCACUCCACUUGGAA | 2306 | UUCCAAGUGGAGUGAAUUC | Rh | [1654-1672] |
| 45 | 1728 | CGGCGCCCUGCUAGUCAAA | 2307 | UUUGACUAGCAGGGCGCCG | Rh | [817-835] |
| 46 | 1729 | UGGAAGCUGGGCAGCCGAA | 2308 | UUCGGCUGCCCAGCUUCCA | | [611-629] |
| 46 | 1730 | GGCAAGGCGACCACGGCGA | 2309 | UCGCCGUGGUCGCCUUGCC | Rh | [482-500] |
| 46 | 1731 | CACUGCGGAGAAGUUGAGA | 2310 | UCUCAACUUCUCCGCAGUG | | [322-340] |
| 46 | 1732 | GGCAGGAGGCAUCCAAAGA | 2311 | UCUUUGGAUGCCUCCUGCC | | [1509-1527] |
| 46 | 1733 | GGUGACUCGGUCCUAUACA | 2312 | UGUAUAGGACCGAGUCACC | Rh | [904-922] |
| 46 | 1734 | UUUAUAGCCAGGUACCUUA | 2313 | UAAGGUACCUGGCUAUAAA | Rh | [1792-1810] |
| 46 | 1735 | GGCCAUGGCCAAGGACCAA | 2314 | UUGGUCCUUGGCCAUGGCC | Rh, D | [397-415] |
| 46 | 1736 | CAAAGAUAGGGAGGGAAGA | 2315 | UCUUCCCUCCCUAUCUUUG | | [2089-2107] |
| 46 | 1737 | UCUUCUGACACUAAAACAA | 2316 | UUGUUUUAGUGUCAGAAG | | [1853-1871] |
| 46 | 1738 | CUUCUGACACUAAAACACA | 2317 | UGUGUUUUAGUGUCAGAA | | [1854-1872] |
| 47 | 1739 | UCACGUGGAGCCUCUCGAA | 2318 | UUCGAGAGGCUCCACGUGA | | [1048-1066] |
| 47 | 1740 | CAGUCCAUCAACGAGUGGA | 2319 | UCCACUCGUUGAUGGACUG | Rh, Rt, M | [740-758] |
| 47 | 1741 | AGACCAAAUUGAGCUAGGA | 2320 | UCCUAGCUCAAUUUGGUCU | | [1820-1838] |
| 47 | 1742 | GGGUUCCCGUGUGCCUGAA | 2321 | UUCAGGCACACGGGAACCC | Rh | [1619-1637] |
| 47 | 1743 | UUGCUAUCAAUCCAAGAAA | 2322 | UUUCUUGGAUUGAUAGCAA | Rh | [2125-2143] |
| 47 | 1744 | CAACCGUGGCUUCAUGGUA | 2323 | UACCAUGAAGCCACGGUUG | Rh, Rt, M | [889-907] |
| 47 | 1745 | CUGUACGGACCCAGCUCAA | 2324 | UUGAGCUGGGUCCGUACAG | | [629-647] |
| 47 | 1746 | CAGCAGCAAGCAGCACUAA | 2325 | UUAGUGCUGCUUGCUGCUG | Rh, D | [673-691] |
| 47 | 1747 | CCUGCAGCCGCAGCAGCUA | 2326 | UAGCUGCUGCGGCUGCAGG | | [299-317] |
| 47 | 1748 | GACACUAAAACACCUCAGA | 2327 | UCUGAGGUGUUUUAGUGUC | | [1859-1877] |
| 48 | 1749 | CAACUGCGAGCACUCCAAA | 2328 | UUUGGAGUGCUCGCAGUUG | Rh, D | [691-709] |
| 48 | 1750 | ACUGCGGAGAAGUUGAGCA | 2329 | UGCUCAACUUCUCCGCAGU | | [323-341] |
| 48 | 1751 | GCGCCCUGCUAGUCAACGA | 2330 | UCGUUGACUAGCAGGGCGC | Rh | [819-837] |

TABLE D-continued

SERPINH1 Active 18 + 1-mer siRNAs

| No | SEQ ID | Sense siRNA | SEQ ID | AntiSense siRNA | Other Sp | human- |
|----|--------|-------------|--------|-----------------|----------|--------|
| 48 | 1752 | GGAAGCUGGGCAGCCGACA | 2331 | UGUCGGCUGCCCAGCUUCC | | [612-630] |
| 48 | 1753 | AGGCUCCUGAGACACAUGA | 2332 | UCAUGUGUCUCAGGAGCCU | D | [1525-1543] |
| 48 | 1754 | CGACAAGCGCAGCGCGCUA | 2333 | UAGCGCGCUGCGCUUGUCG | | [721-739] |
| 48 | 1755 | UCAGUGAGCUUCGCUGAUA | 2334 | UAUCAGCGAAGCUCACUGA | | [644-662] |
| 48 | 1756 | UUGAGAAGGAGCUCCCAGA | 2335 | UCUGGGAGCUCCUUCUCAA | | [1979-1997] |
| 48 | 1757 | ACUGCGAGCACUCCAAGAA | 2336 | UUCUUGGAGUGCUCGCAGU | Rh, D | [693-711] |
| 48 | 1758 | CAUCCUGGUGUCACCCGUA | 2337 | UACGGGUGACACCAGGAUG | | [427-445] |
| 49 | 1759 | GUGCGCAGCAGCAAGCAGA | 2338 | UCUGCUUGCUGCUGCGCAC | Rh, D | [668-686] |
| 49 | 1760 | CACGCCACCGCCUUUGAGA | 2339 | UCUCAAAGGCGGUGGCGUG | Rh | [1286-1304] |
| 49 | 1761 | UCUCGAGCGCCUUGAAAAA | 2340 | UUUUUCAAGGCGCUCGAGA | | [1060-1078] |
| 49 | 1762 | GCUUCGCUGAUGACUUCGA | 2341 | UCGAAGUCAUCAGCGAAGC | Rh | [651-669] |
| 49 | 1763 | UCUCCUUGCCCAAGGGUGA | 2342 | UCACCCUUGGGCAAGGAGA | Rh | [1140-1158] |
| 49 | 1764 | GCAGUCCAUCAACGAGUGA | 2343 | UCACUCGUUGAUGGACUGC | Rh, Rt, M | [739-757] |
| 49 | 1765 | AGAUGGUGGACAACCGUGA | 2344 | UCACGGUUGUCCACCAUCU | Rh, M | [879-897] |
| 49 | 1766 | CGGCUCCCUGCUAUUCAUA | 2345 | UAUGAAUAGCAGGGAGCCG | | [1420-1438] |
| 49 | 1767 | AUACCAUGAUGCUGAGCCA | 2346 | UGGCUCAGCAUCAUGGUAU | | [1684-1702] |
| 49 | 1768 | AGCCAGGUACCUUCUCACA | 2347 | UGUGAGAAGGUACCUGGCU | Rh | [1797-1815] |
| 50 | 1769 | GAGCCCGGAAACUCCACAA | 2348 | UUGUGGAGUUUCCGGGCUC | | [1697-1715] |
| 50 | 1770 | GCAGCUCCUGGCACUGCGA | 2349 | UCGCAGUGCCAGGAGCUGC | | [311-329] |
| 50 | 1771 | CCCGAGGUCACCAAGGACA | 2350 | UGUCCUUGGUGACCUCGGG | Rh, D | [785-803] |
| 50 | 1772 | CCUGACUGAGGCCAUUGAA | 2351 | UUCAAUGGCCUCAGUCAGG | Rh | [1204-1222] |
| 50 | 1773 | UGCUGAGCCCGGAAACUCA | 2352 | UGAGUUUCCGGGCUCAGCA | | [1693-1711] |
| 50 | 1774 | GCCAUCUCCUUGCCCAAGA | 2353 | UCUUGGGCAAGGAGAUGGC | Rh | [1136-1154] |
| 50 | 1775 | CAAGCAGCACUACAACUGA | 2354 | UCAGUUGUAGUGCUGCUUG | Rh, D | [679-697] |
| 50 | 1776 | CAAGGCAGUGCUGAGCGCA | 2355 | UGCGCUCAGCACUGCCUUG | Rh | [508-526] |
| 50 | 1777 | CAAUGACAUUUUGUUGGAA | 2356 | UUCCAACAAAAUGUCAUUG | | [2179-2197] |
| 50 | 1778 | AGUGAGCUUCGCUGAUGAA | 2357 | UUCAUCAGCGAAGCUCACU | | [646-664] |
| 51 | 1779 | AUGAUGAUGCACCGGACAA | 2358 | UUGUCCGGUGCAUCAUCAU | Rh | [932-950] |
| 51 | 1780 | GAAACACCUGGCUGGGCUA | 2359 | UAGCCCAGCCAGGUGUUUC | D | [1183-1201] |
| 51 | 1781 | CCUGCUAUUCAUUGGGCGA | 2360 | UCGCCCAAUGAAUAGCAGG | D | [1426-1444] |
| 51 | 1782 | CGCCACCGCCUUUGAGUUA | 2361 | UAACUCAAAGGCGGUGGCG | Rh | [1288-1306] |
| 51 | 1783 | GCUUCUCAGCGCCUUCUGA | 2362 | UCAGAAGGCGCUGAGAAGC | | [244-262] |
| 51 | 1784 | UGAUGCUGAGCCCGGAAAA | 2363 | UUUUCCGGGCUCAGCAUCA | | [1690-1708] |
| 51 | 1785 | UGACCUGGCCGCAGUGAGA | 2364 | UCUCACUGCGGCCAGGUCA | | [1956-1974] |
| 51 | 1786 | UGCAGAAACACCUGGCUGA | 2365 | UCAGCCAGGUGUUUCUGCA | | [1179-1197] |
| 51 | 1787 | GCAGUGCUGAGCGCCGAGA | 2366 | UCUCGGCGCUCAGCACUGC | | [512-530] |
| 51 | 1788 | CGGCGCGCAACGUGACCUA | 2367 | UAGGUCACGUUGCGCGCCG | | [594-612] |
| 52 | 1789 | AGUGCUGAGCGCCGAGCAA | 2368 | UUGCUCGGCGCUCAGCACU | | [514-532] |

TABLE D-continued

SERPINH1 Active 18 + 1-mer siRNAs

| No | SEQ ID | Sense siRNA | SEQ ID | AntiSense siRNA | Other Sp | human- |
|---|---|---|---|---|---|---|
| 52 | 1790 | ACAGGCCUCUACAACUACA | 2369 | UGUAGUUGUAGAGGCCUGU | Rh, Rb, D, | [947-965] |
| 52 | 1791 | GCAGCUGCGCGACGAGGAA | 2370 | UUCCUCGUCGCGCAGCUGC | Rh, D | [529-547] |
| 52 | 1792 | AUUGAGAAGGAGCUCCCAA | 2371 | UUGGGAGCUCCUUCUCAAU | | [1978-1996] |
| 52 | 1793 | CGCGCAGACCACCGACGGA | 2372 | UCCGUCGGUGGUCUGCGCG | | [760-778] |
| 52 | 1794 | CCUGUACCUGGCCAGCGUA | 2373 | UACGCUGGCCAGGUACAGG | Rh | [1264-1282] |
| 52 | 1795 | CUGAGCGGACCUUCCCAGA | 2374 | UCUGGGAAGGUCCGCUCAG | Rh | [1633-1651] |
| 52 | 1796 | GGCCUUCAGCUUGUACCAA | 2375 | UUGGUACAAGCUGAAGGCC | | [379-397] |
| 52 | 1797 | CACCCAAAGCGGCUCCCUA | 2376 | UAGGGAGCCGCUUUGGGUG | | [1411-1429] |
| 52 | 1798 | GCCAAGGACCAGGCAGUGA | 2377 | UCACUGCCUGGUCCUUGGC | Rh | [404-422] |
| 53 | 1799 | CUCAGGGUGCACACAGGAA | 2378 | UUCCUGUGUGCACCCUGAG | | [1490-1508] |
| 53 | 1800 | CGAGCUGCUGCGCUCACUA | 2379 | UAGUGAGCGCAGCAGCUCG | Rh | [565-583] |
| 53 | 1801 | GGCUGGGCCUGACUGAGGA | 2380 | UCCUCAGUCAGGCCCAGCC | | [1197-1215] |
| 53 | 1802 | CCGCAGCAGCUCCUGGCAA | 2381 | UUGCCAGGAGCUGCUGCGG | | [306-324] |
| 53 | 1803 | UGUGGGACCUGGGCCAUAA | 2382 | UUAUGGCCCAGGUCCCACA | | [1718-1736] |
| 53 | 1804 | AAGAUGCAGAAGAAGGCUA | 2383 | UAGCCUUCUUCUGCAUCUU | Rh, Rt, M | [1115-1133] |
| 53 | 1805 | CCACGGCGCAACGUGAA | 2384 | UUCACGUUGCGCGCCGUGG | Rh | [591-609] |
| 53 | 1806 | ACCUUCUCACCUGUGAGAA | 2385 | UUCUCACAGGUGAGAAGGU | Rh | [1805-1823] |
| 53 | 1807 | UGAAGAAACCUGCAGCCGA | 2386 | UCGGCUGCAGGUUUCUUCA | | [291-309] |
| 53 | 1808 | CAGCACUACAACUGCGAGA | 2387 | UCUCGCAGUUGUAGUGCUG | Rh, D | [683-701] |
| 54 | 1809 | GCGACAAGCGCAGCGCGCA | 2388 | UGCGCGCUGCGCUUGUCGC | | [720-738] |
| 54 | 1810 | UAGAAUUCACUCCACUUGA | 2389 | UCAAGUGGAGUGAAUUCUA | Rh | [1652-1670] |
| 54 | 1811 | GUGGAAAAACAGACCGGGA | 2390 | UCCCGGUCUGUUUUUCCAC | | [1603-1621] |
| 54 | 1812 | ACGUGGAGCCUCUCGAGCA | 2391 | UGCUCGAGAGGCUCCACGU | | [1050-1068] |
| 54 | 1813 | GGCGCGCAACGUGACCUGA | 2392 | UCAGGUCACGUUGCGCGCC | | [595-613] |
| 54 | 1814 | UGGACAACCGUGGCUUCAA | 2393 | UUGAAGCCACGGUUGUCCA | Rh, M | [885-903] |
| 54 | 1815 | CUAGUCAACGCCAUGUUCA | 2394 | UGAACAUGGCGUUGACUAG | Rh | [827-845] |
| 54 | 1816 | AGAAUGACCUGGCCGCAGA | 2395 | UCUGCGGCCAGGUCAUUCU | | [1952-1970] |
| 54 | 1817 | AGCUGCUGCGCUCACUCAA | 2396 | UUGAGUGAGCGCAGCAGCU | Rh | [567-585] |
| 54 | 1818 | CUCUAUCCCAACCUCUCCA | 2397 | UGGAGAGGUUGGGAUAGA | Rh | [1889-1907] |
| 55 | 1819 | GCGAGCUGCUGCGCUCACA | 2398 | UGUGAGCGCAGCAGCUCGC | Rh | [564-582] |
| 55 | 1820 | CGCAGCAGCAAGCAGCACA | 2399 | UGUGCUGCUUGCUGCUGCG | Rh, D | [671-689] |
| 55 | 1821 | GGCUGGGCUGGGCCUGACA | 2400 | UGUCAGGCCCAGCCCAGCC | | [1192-1210] |
| 55 | 1822 | UCUCCAGCCUCAUCAUCCA | 2401 | UGGAUGAUGAGGCUGGAG | Rh, D, Rt, | [1020-1038] |
| 55 | 1823 | CAACGCCAUGUUCUUCAAA | 2402 | UUUGAAGAACAUGGCGUUG | Rh, Rb, P | [832-850] |
| 55 | 1824 | UGGCACUGCGGAGAAGUUA | 2403 | UAACUUCUCCGCAGUGCCA | | [319-337] |
| 55 | 1825 | UUUGAGUUGGACACAGAUA | 2404 | UAUCUGUGUCCAACUCAAA | | [1298-1316] |
| 55 | 1826 | UGGGCGAGCUGCUGCGCUA | 2405 | UAGCGCAGCAGCUCGCCCA | Rh | [561-579] |
| 55 | 1827 | CUGCUAACCAAAGAGCAGA | 2406 | UCUGCUCUUUGGUUAGCAG | | [1079-1097] |

TABLE D-continued

SERPINH1 Active 18 + 1-mer siRNAs

| No | SEQ ID | Sense siRNA | SEQ ID | AntiSense siRNA | Other Sp | human- |
|---|---|---|---|---|---|---|
| 55 | 1828 | AACGUGACCUGGAAGCUGA | 2407 | UCAGCUUCCAGGUCACGUU | | [602-620] |
| 56 | 1829 | AUGACAUUUGUUGGAGCA | 2408 | UGCUCCAACAAAUGUCAU | | [2181-2199] |
| 56 | 1830 | CAGGAGGCAUCCAAAGGCA | 2409 | UGCCUUUGGAUGCCUCCUG | | [1511-1529] |
| 56 | 1831 | AUCUCCUUGCCAAGGGUA | 2410 | UACCCUUGGGCAAGGAGAU | Rh | [1139-1157] |
| 56 | 1832 | UGGGAUGAGAAAUUCCACA | 2411 | UGUGGAAUUUCUCAUCCCA | Rh | [857-875] |
| 56 | 1833 | AAAGCUGCUAACCAAAGAA | 2412 | UUCUUUGGUUAGCAGCUUU | | [1075-1093] |
| 56 | 1834 | AGGAGGCAUCCAAAGGCUA | 2413 | UAGCCUUUGGAUGCCUCCU | | [1512-1530] |
| 56 | 1835 | CACCGCCUUUGAGUUGGAA | 2414 | UUCCAACUCAAAGGCGGUG | Rh | [1291-1309] |
| 56 | 1836 | CCAACUAUAAAACUAGGUA | 2415 | UACCUAGUUUUAUAGUUGG | Rh | [1906-1924] |
| 56 | 1837 | CAAGAAGCAUCGUGUCUGA | 2416 | UCAGACACGAUGCUUCUUG | Rh | [2022-2040] |
| 56 | 1838 | AGCAGCUGAAGAUCUGGAA | 2417 | UUCCAGAUCUUCAGCUGCU | Rh, D | [1092-1110] |
| 57 | 1839 | GCGCUCCCUCCUGCUUCUA | 2418 | UAGAAGCAGGAGGGAGCGC | | [232-250] |
| 57 | 1840 | UGCUAGUCAACGCCAUGUA | 2419 | UACAUGGCGUUGACUAGCA | Rh | [825-843] |
| 57 | 1841 | CGCCGAGCAGCUGCGCAA | 2420 | UUCGCGCAGCUGCUCGGCG | | [523-541] |
| 57 | 1842 | CCGCGCAGACCACCGACGA | 2421 | UCGUCGGUGGUCUGCGCGG | | [759-777] |
| 57 | 1843 | UAGCCAGGUACCUUCUCAA | 2422 | UUGAGAAGGUACCUGGCUA | Rh | [1796-1814] |
| 57 | 1844 | UGCUUCUCAGCGCCUUCUA | 2423 | UAGAAGGCGCUGAGAAGCA | | [243-261] |
| 57 | 1845 | CUCCCUCCUGCUUCUCAGA | 2424 | UCUGAGAAGCAGGAGGGAG | | [235-253] |
| 57 | 1846 | CGCAGGCCAAGGCAGUGCA | 2425 | UGCACUGCCUUGGCCUGCG | | [501-519] |
| 57 | 1847 | GCAAGGCGACCACGGCGUA | 2426 | UACGCCGUGGUCGCCUUGC | Rh | [483-501] |
| 57 | 1848 | GCAGCCGCAGCAGCUCCUA | 2427 | UAGGAGCUGCUGCGGCUGC | | [302-320] |

TABLE E

SERPINH1 Cross-Species 18 + 1-mer siRNAs

| No. | SEQ ID NO | Sense siRNA | SEQ | AntiSense siRNA | Other | human- |
|---|---|---|---|---|---|---|
| 1 | 2428 | UCACCAAGGACGUGGAGCA | 2576 | UGCUCCACGUCCUUGGU | Rh, D | [792-810] |
| 2 | 2429 | CAGCGCGCUGCAGUCCAUA | 2577 | UAUGGACUGCAGCGCGC | Rh, Rt | [730-748] |
| 3 | 2430 | CAUCUACGGGCGCGAGGAA | 2578 | UUCCUCGCGCCCGUAGA | D, M | [1336-1354] |
| 4 | 2431 | CUCCAGCCUCAUCAUCCUA | 2579 | UAGGAUGAUGAGGCUGG | Rh, D, Rt, M | [1021-1039] |
| 5 | 2432 | GACAUCUACGGGCGCGAGA | 2580 | UCUCGCGCCCGUAGAUG | D, M | [1334-1352] |
| 6 | 2433 | CGUGCGCAGCAGCAAGCAA | 2581 | UUGCUUGCUGCUGCGCA | Rh, D, M | [667-685] |
| 7 | 2434 | GUCACCAAGGACGUGGAGA | 2582 | UCUCCACGUCCUUGGUG | Rh, D | [791-809] |
| 8 | 2435 | CCGCGACAAGCGCAGCGCA | 2583 | UGCGCUGCGCUUGUCGC | D | [718-736] |
| 9 | 2436 | GCGCAGCGCGCUGCAGUCA | 2584 | UGACUGCAGCGCGCUGC | Rh, Rt | [727-745] |
| 10 | 2437 | GGCCCACAAGCUCUCCAGA | 2585 | UCUGGAGAGCUUGUGGG | Rh, D, P | [1009-1027] |
| 11 | 2438 | CAAGGACGUGGAGCGCACA | 2586 | UGUGCGCUCCACGUCCU | Rh, D | [796-814] |
| 12 | 2439 | AGCCUCAUCAUCCCACAUGA | 2587 | UCAUGAGGAUGAUGAGG | Rh, D, Rt, M | [1025-1043] |
| 13 | 2440 | GGUGUGGUGGAGGUGACCA | 2588 | UGGUCACCUCCACCACA | Rh, D | [1154-1172] |

TABLE E-continued

SERPINH1 Cross-Species 18 + 1-mer siRNAs

| No. | SEQ ID NO | Sense siRNA | SEQ | AntiSense siRNA | Other | human- |
|---|---|---|---|---|---|---|
| 14 | 2441 | GCAAGCUGCCCGAGGUCAA | 2589 | UUGACCUCGGGCAGCUU | Rh, D | [777-795] |
| 15 | 2442 | GUGGAGGUGACCCAUGACA | 2590 | UGUCAUGGGUCACCUCC | Rh, Rt, M | [1160-1178] |
| 16 | 2443 | CACAAGAUGGUGGACAACA | 2591 | UGUUGUCCACCAUCUUG | Rh, Rb, M, P | [875-893] |
| 17 | 2444 | GCGAGGAGCUGCGCAGCCA | 2592 | UGGCUGCGCAGCUCCUC | D, M | [1347-1365] |
| 18 | 2445 | UACUACGACGACGAGAAGA | 2593 | UCUUCUCGUCGUCGUAG | Rb | [962-980] |
| 19 | 2446 | GAGGUGACCCAUGACCUGA | 2594 | UCAGGUCAUGGGUCACC | Rh, Rt, M | [1163-1181] |
| 20 | 2447 | ACUUCCGCGACAAGCGCAA | 2595 | UUGCGCUUGUCGCGGAA | D | [714-732] |
| 21 | 2448 | GCCCACAAGCUCUCCAGCA | 2596 | UGCUGGAGAGCUUGUGG | Rh, D, P | [1010-1028] |
| 22 | 2449 | GCGCAGCAGCAAGCAGCAA | 2597 | UUGCUGCUUGCUGCUGC | Rh, D | [670-688] |
| 23 | 2450 | CGAGGAGCUGCGCAGCCCA | 2598 | UGGGCUGCGCAGCUCCU | D, M | [1348-1366] |
| 24 | 2451 | AACGCCAUGUUCUUCAAGA | 2599 | UCUUGAAGAACAUGGCG | Rh, Rb, P | [833-851] |
| 25 | 2452 | GUCAGGCAAGAAGGACCUA | 2600 | UAGGUCCUUCUUGCCUG | Rh, D | [1249-1267] |
| 26 | 2453 | GCCUGGGCGAGCUGCUGCA | 2601 | UGCAGCAGCUCGCCCAG | Rh, D | [558-576] |
| 27 | 2454 | GAUGAUGCACCGGACAGGA | 2602 | UCCUGUCCGGUGCAUCA | Rh, Rb, Rt, M | [934-952] |
| 28 | 2455 | GGACCUGUACCUGGCCAGA | 2603 | UCUGGCCAGGUACAGGU | Rh, D | [1261-1279] |
| 29 | 2456 | GCGACGAGGAGGUGCACGA | 2604 | UCGUGCACCUCCUCGUC | D | [537-555] |
| 30 | 2457 | UGUGGUGGAGGUGACCCAA | 2605 | UUGGGUCACCUCCACCA | Rh, D | [1156-1174] |
| 31 | 2458 | UUCAAGCCACACUGGGAUA | 2606 | UAUCCCAGUGUGGCUUG | Rh, Rb | [845-863] |
| 32 | 2459 | CAAGAUGGUGGACAACCGA | 2607 | UCGGUUGUCCACCAUCU | Rh, Rb, M, P | [877-895] |
| 33 | 2460 | UCAACUUCCGCGACAAGCA | 2608 | UGCUUGUCGCGGAAGUU | D | [711-729] |
| 34 | 2461 | AUUCAUUGGGCGCCUGGUA | 2609 | UACCAGGCGCCCAAUGA | D | [1432-1450] |
| 35 | 2462 | CUCCAAGAUCAACUUCCGA | 2610 | UCGGAAGUUGAUCUUGG | Rh, D, Rt, M | [703-721] |
| 36 | 2463 | CAGGCCAUGGCCAAGGACA | 2611 | UGUCCUUGGCCAUGGCC | Rh, D | [395-413] |
| 37 | 2464 | GUACCAGGCCAUGGCCAAA | 2612 | UUUGGCCAUGGCCUGGU | Rh, D | [391-409] |
| 38 | 2465 | UGUCAGGCAAGAAGGACCA | 2613 | UGGUCCUUCUUGCCUGA | Rh, D | [1248-1266] |
| 39 | 2466 | CUUCGUGCGCAGCAGCAAA | 2614 | UUUGCUGCUGCGCACGA | Rh, D, M | [664-682] |
| 40 | 2467 | CAACUUCCGCGACAAGCGA | 2615 | UCGCUUGUCGCGGAAGU | D | [712-730] |
| 41 | 2468 | CCACCAAGAUGGUGGAA | 2616 | UUCCACCAUCUUGUGGU | Rh, Rb, D, P | [871-889] |
| 42 | 2469 | GCGCGACGAGGAGGUGCAA | 2617 | UUGCACCUCCUCGUCGC | Rh, D | [535-553] |
| 43 | 2470 | CUACAACUGCGAGCACUCA | 2618 | UGAGUGCUCGCAGUUGU | Rh, D | [688-706] |
| 44 | 2471 | UGGAGGUGACCCAUGACCA | 2619 | UGGUCAUGGGUCACCUC | Rh, Rt, M | [1161-1179] |
| 45 | 2472 | GAGGUCACCAAGGACGUGA | 2620 | UCACGUCCUUGGUGACC | Rh, D | [788-806] |
| 46 | 2473 | AAGAAGGACCUGUACCUGA | 2621 | UCAGGUACAGGUCCUUC | Rh, D | [1256-1274] |
| 47 | 2474 | GACAACCGUGGCUUCAUGA | 2622 | UCAUGAAGCCACGGUUG | Rh, Rt, M | [887-905] |
| 48 | 2475 | ACCAGGACAUCUACGGGCA | 2623 | UGCCCGUAGAUGUCCUG | D, Rt | [1329-1347] |
| 49 | 2476 | GCUGCCCGAGGUCACCAAA | 2624 | UUUGGUGACCUCGGGCA | Rh, D | [781-799] |
| 50 | 2477 | AUGCAGAAGAAGGCUGUUA | 2625 | UAACAGCCUUCUUCUGC | Rt | [1118-1136] |
| 51 | 2478 | GGCCUGGGCGAGCUGCUGA | 2626 | UCAGCAGCUCGCCCAGG | Rh, D | [557-575] |

TABLE E-continued

SERPINH1 Cross-Species 18 + 1-mer siRNAs

| No. | SEQ ID NO | Sense siRNA | SEQ | AntiSense siRNA | Other | human- |
|---|---|---|---|---|---|---|
| 52 | 2479 | GAUGGUGGACAACCGUGGA | 2627 | UCCACGGUUGUCCACCA | Rh, M | [880-898] |
| 53 | 2480 | CUCCCUGCUAUUCAUUGGA | 2628 | UCCAAUGAAUAGCAGGG | D | [1423-1441] |
| 54 | 2481 | GAAGGACCUGUACCUGGCA | 2629 | UGCCAGGUACAGGUCCU | Rh, D | [1258-1276] |
| 55 | 2482 | CCACCGACGGCAAGCUGCA | 2630 | UGCAGCUUGCCGUCGGU | D, Rt | [768-786] |
| 56 | 2483 | UGCUAUUCAUUGGGCGCCA | 2631 | UGGCGCCCAAUGAAUAG | D | [1428-1446] |
| 57 | 2484 | AUGUUCUUCAAGCCACACA | 2632 | UGUGUGGCUUGAAGAAC | Rh, Rb, D | [839-857] |
| 58 | 2485 | CCAGGACAUCUACGGGCGA | 2633 | UCGCCCGUAGAUGUCCU | D, Rt | [1330-1348] |
| 59 | 2486 | GCGCGAGGAGCUGCGCAGA | 2634 | UCUGCGCAGCUCCUCGC | Rh, D, M | [1345-1363] |
| 60 | 2487 | GAGCAGCUGCGCGACGAGA | 2635 | UCUCGUCGCGCAGCUGC | Rh, D | [527-545] |
| 61 | 2488 | CUAUUCAUUGGGCGCCUGA | 2636 | UCAGGCGCCCAAUGAAU | D | [1430-1448] |
| 62 | 2489 | ACAAGCUCUCCAGCCUCAA | 2637 | UUGAGGCUGGAGAGCUU | Rh, D, M, P | [1014-1032] |
| 63 | 2490 | GCUGAAGAUCUGGAUGGGA | 2638 | UCCCAUCCAGAUCUUCA | Rh, D | [1096-1114] |
| 64 | 2491 | GACCAGGACAUCUACGGGA | 2639 | UCCCGUAGAUGUCCUGG | D, Rt | [1328-1346] |
| 65 | 2492 | CAAGCGCAGCGCGCUGCAA | 2640 | UUGCAGCGCGCUGCGCU | Rh, Rt | [724-742] |
| 66 | 2493 | CCAUGGCCAAGGACCAGGA | 2641 | UCCUGGUCCUUGGCCAU | Rh, D | [399-417] |
| 67 | 2494 | CACCAAGGACGUGGAGCGA | 2642 | UCGCUCCACGUCCUUGG | Rh, D | [793-811] |
| 68 | 2495 | CCGUGGCUUCAUGGUGACA | 2643 | UGUCACCAUGAAGCCAC | Rh, Rt, M | [892-910] |
| 69 | 2496 | UGACCAGGACAUCUACGGA | 2644 | UCCGUAGAUGUCCUGGU | Rt | [1327-1345] |
| 70 | 2497 | AGACCACCGACGGCAAGCA | 2645 | UGCUUGCCGUCGGUGGU | D, Rt | [765-783] |
| 71 | 2498 | GACAAGCGCAGCGCGCUGA | 2646 | UCAGCGCGCUGCGCUUG | Rh, Rt | [722-740] |
| 72 | 2499 | AGAAACACCUGGCUGGGCA | 2647 | UGCCCAGCCAGGUGUUU | D | [1182-1200] |
| 73 | 2500 | AAGAUGGUGGACAACCGUA | 2648 | UACGGUUGUCCACCAUC | Rh, M | [878-896] |
| 74 | 2501 | CAGACCACCGACGGCAAGA | 2649 | UCUUGCCGUCGGUGGUC | D, Rt | [764-782] |
| 75 | 2502 | AGGACCUGUACCUGGCCAA | 2650 | UUGGCCAGGUACAGGUC | Rh, D | [1260-1278] |
| 76 | 2503 | CUGCUAUUCAUUGGGCGCA | 2651 | UGCGCCCAAUGAAUAGC | D | [1427-1445] |
| 77 | 2504 | GUCCAUCAACGAGUGGGCA | 2652 | UGCCCACUCGUUGAUGG | Rh, Rt, M | [742-760] |
| 78 | 2505 | CCAGGCCAUGGCCAAGGAA | 2653 | UUCCUUGGCCAUGGCCU | Rh, D | [394-412] |
| 79 | 2506 | AAGCAGCACUACAACUGCA | 2654 | UGCAGUUGUAGUGCUGC | Rh, D | [680-698] |
| 80 | 2507 | UGUUCCACGCCACCGCCUA | 2655 | UAGGCGGUGGCGUGGAA | D | [1281-1299] |
| 81 | 2508 | UACAACUACUACGACGACA | 2656 | UGUCGUCGUAGUAGUUG | Rb | [956-974] |
| 82 | 2509 | CCUCAUCAUCCUCAUGCCA | 2657 | UGGCAUGAGGAUGAUGA | Rh, D, Rt, M | [1027-1045] |
| 83 | 2510 | UGGUGGACAACCGUGGCUA | 2658 | UAGCCACGGUUGUCCAC | Rh, M | [882-900] |
| 84 | 2511 | GACCACCGACGGCAAGCUA | 2659 | UAGCUUGCCGUCGGUGG | D, Rt | [766-784] |
| 85 | 2512 | AGCUGCGCGACGAGGAGGA | 2660 | UCCUCCUCGUCGCGCAG | Rh, D | [531-549] |
| 86 | 2513 | CGGCAAGCUGCCCGAGGUA | 2661 | UACCUCGGGCAGCUUGC | Rh, D | [775-793] |
| 87 | 2514 | UGGCCCACAAGCUCUCCAA | 2662 | UUGGAGAGCUUGUGGGC | Rh, D, P | [1008-1026] |
| 88 | 2515 | CAGCUGCGCGACAGGAGA | 2663 | UCUCCUCGUCGCGCAGC | Rh, D | [530-548] |
| 89 | 2516 | CUUCCGCGACAAGCGCAGA | 2664 | UCUGCGCUUGUCGCGGA | D | [715-733] |

TABLE E-continued

SERPINH1 Cross-Species 18 + 1-mer siRNAs

| No. | SEQ ID NO | Sense siRNA | SEQ | AntiSense siRNA | Other | human- |
|---|---|---|---|---|---|---|
| 90 | 2517 | UGGGCCUGACUGAGGCCAA | 2665 | UUGGCCUCAGUCAGGCC | Rt | [1200-1218] |
| 91 | 2518 | GCUGCGCGACGAGGAGGUA | 2666 | UACCUCCUCGUCGCGCA | Rh, D | [532-550] |
| 92 | 2519 | CAGGACAUCUACGGGCGCA | 2667 | UGCGCCCGUAGAUGUCC | D | [1331-1349] |
| 93 | 2520 | GCCAUGCCGAAGGACCAGA | 2668 | UCUGGUCCUUGGCCAUG | Rh, D | [398-416] |
| 94 | 2521 | UCCAAGAUCAACUUCCGCA | 2669 | UGCGGAAGUUGAUCUUG | D | [704-722] |
| 95 | 2592 | ACCACCGACGGCAAGCUGA | 2670 | UCAGCUUGCCGUCGGUG | D, Rt | [767-785] |
| 96 | 2523 | AUCUACGGGCGCGAGGAGA | 2671 | UCUCCUCGCGCCCGUAG | D, M | [1337-1355] |
| 97 | 2524 | CUGCCCGAGGUCACCAAGA | 2672 | UCUUGGUGACCUCGGGC | Rh, D | [782-800] |
| 98 | 2525 | AUCAACUUCCGCGACAAGA | 2673 | UCUUGUCGCGGAAGUUG | D | [710-728] |
| 99 | 2526 | UCAUUGGGCGCCUGGUCCA | 2674 | UGGACCAGGCGCCCAAU | Rh, D | [1434-1452] |
| 100 | 2527 | CAUUGGGCGCCUGGUCCGA | 2675 | UCGGACCAGGCGCCCAA | Rh, D | [1435-1453] |
| 101 | 2528 | GUGUUCCACGCCACCGCCA | 2676 | UGGCGGUGGCGUGGAAC | D | [1280-1298] |
| 102 | 2529 | AUGAUGCACCGGACAGGCA | 2677 | UGCCUGUCCGGUGCAUC | Rh, Rb, Rt, M | [935-953] |
| 103 | 2530 | CGACGAGGAGGUGCACGCA | 2678 | UGCGUGCACCUCCUCGU | D | [538-556] |
| 104 | 2531 | CAGAAACACCUGGCUGGGA | 2679 | UCCCAGCCAGGUGUUUC | D | [1181-1199] |
| 105 | 2532 | UGAUGCACCGGACAGGCCA | 2680 | UGGCCUGUCCGGUGCAU | Rh, Rb, Rt, M | [936-954] |
| 106 | 2533 | AAGGCUGUUGCCAUCUCCA | 2681 | UGGAGAUGGCAACAGCC | D, Rt | [1127-1145] |
| 107 | 2534 | AUGACUUCGUGCGCAGCAA | 2682 | UUGCUGCGCACGAAGUC | Rh, Rt, M | [660-678] |
| 108 | 2535 | UCAGGCAAGAAGGACCUGA | 2683 | UCAGGUCCUUCUUGCCU | Rh, D | [1250-1268] |
| 109 | 2536 | CUCAUCAUCCUCAUGCCCA | 2684 | UGGGCAUGAGGAUGAUG | Rh, Rt, M | [1028-1046] |
| 110 | 2537 | CGCGACGAGGAGGUGCACA | 2685 | UGUGCACCUCCUCGUCG | Rh, D | [536-554] |
| 111 | 2538 | ACAACCGUGGCUUCAUGGA | 2686 | UCCAUGAAGCCACGGUU | Rh, Rt, M | [888-906] |
| 112 | 2539 | UUGACCAGGACAUCCACGA | 2687 | UCGUAGAUGUCCUGGUC | Rt | [1326-1344] |
| 113 | 2540 | CAAGCUGCCCGAGGUCACA | 2688 | UGUGACCUCGGGCAGCU | Rh, D | [778-796] |
| 114 | 2541 | UCCCUGCUAUUCAUUGGGA | 2689 | UCCCAAUGAAUAGCAGG | D | [1424-1442] |
| 115 | 2542 | UAUUCAUUGGGCGCCUGGA | 2690 | UCCAGGCGCCCAAUGAA | D | [1431-1449] |
| 116 | 2543 | CUGCGCGACGAGGAGGUGA | 2691 | UCACCUCCUCGUCGCGC | Rh, D | [533-551] |
| 117 | 2544 | CUACGGGCGCGAGGAGCUA | 2692 | UAGCUCCUCGCGCCCGU | D, M | [1339-1357] |
| 118 | 2545 | CGCGAGGAGCUGCGCAGCA | 2693 | UGCUGCGCAGCUCCUCG | D, M | [1346-1364] |
| 119 | 2546 | ACACCUGGCUGGGCUGGGA | 2694 | UCCCAGCCCAGCCAGGU | D | [1186-1204] |
| 120 | 2547 | UCUACGGGCGCGAGGAGCA | 2695 | UGCUCCUCGCGCCCGUA | D, M | [1338-1356] |
| 121 | 2548 | UUCUUCAAGCCACACUGGA | 2696 | UCCAGUGUGGCUUGAAG | Rh, Rb, D | [842-860] |
| 122 | 2549 | CCUGGGCGAGCUGCUGCGA | 2697 | UCGCAGCAGCUCGCCCA | Rh, D | [559-577] |
| 123 | 2550 | AAGAAGGCUGUUGCCAUCA | 2698 | UGAUGGCAACAGCCUUC | Rt | [1124-1142] |
| 124 | 2551 | CGACGGCAAGCUGCCCGAA | 2699 | UUCGGGCAGCUUGCCGU | D | [772-790] |
| 125 | 2552 | GACGGCAAGCUGCCCGAGA | 2700 | UCUCGGGCAGCUUGCCG | Rh, D | [773-791] |
| 126 | 2553 | UUCAUUGGGCGCCUGGUCA | 2701 | UGACCAGGCGCCCAAUG | Rh, D | [1433-1451] |
| 127 | 2554 | AAGCGCAGCGCGCUGCAGA | 2702 | UCUGCAGCGCGCUGCGC | Rh, Rt | [725-743] |

TABLE E-continued

SERPINH1 Cross-Species 18 + 1-mer siRNAs

| No. | SEQ ID NO | Sense siRNA | SEQ | AntiSense siRNA | Other | human- |
|---|---|---|---|---|---|---|
| 128 | 2555 | CCUGGCCCACAAGCUCUCA | 2703 | UGAGAGCUUGUGGGCCA | Rh, D, P | [1006-1024] |
| 129 | 2556 | ACGGCAAGCUGCCCGAGGA | 2704 | UCCUCGGGCAGCUUGCC | Rh, D | [774-792] |
| 130 | 2557 | UUUGACCAGGACAUCUACA | 2705 | UGUAGAUGUCCUGGUCA | Rt | [1325-1343] |
| 131 | 2558 | UGACUUCGUGCGCAGCAGA | 2706 | UCUGCUGCGCACGAAGU | Rh, Rt, M | [661-679] |
| 132 | 2559 | AAGGACGUGGAGCGCACGA | 2707 | UCGUGCGCUCCACGUCC | Rh, D | [797-815] |
| 133 | 2560 | UCCAUCAACGAGUGGGCCA | 2708 | UGGCCCACUCGUUGAUG | Rt, M | [743-761] |
| 134 | 2561 | CACCGACGCCAACCUGCCA | 2709 | UGGCAGCUUGCCGUCGG | D, Rt | [769-787] |
| 135 | 2562 | ACGGGCGCGAGGAGCUGCA | 2710 | UGCAGCUCCUCGCGCCC | D, M | [1341-1359] |
| 136 | 2563 | UCCGCGACAAGCGCAGCGA | 2711 | UCGCUGCGCUUGUCGCG | D | [717-735] |
| 137 | 2564 | UUGGGCGCCUGGUCCGGCA | 2712 | UGCCGGACCAGGCGCCC | Rh, D | [1437-1455] |
| 138 | 2565 | AUGGUGGACAACCGUGGCA | 2713 | UGCCACGGUUGUCCACC | Rh, M | [881-899] |
| 139 | 2566 | AUUGGGCGCCUGGUCCGGA | 2714 | UCCGGACCAGGCGCCCA | Rh, D | [1436-1454] |
| 140 | 2567 | UACGGGCGCGAGGAGCUGA | 2715 | UCAGCUCCUCGCGCCCG | D, M | [1340-1358] |
| 141 | 2568 | AUGCACCGGACAGGCCUCA | 2716 | UGAGGCCUGUCCGGUGC | Rh, Rb, Rt, P | [938-956] |
| 142 | 2569 | UUCCACCACAAGAUGGUGA | 2717 | UCACCAUCUUGUGGUGG | Rh, Rb, D, P | [869-887] |
| 143 | 2570 | UUCCGCGACAAGCGCAGCA | 2718 | UGCUGCGCUUGUCGCGG | D | [716-734] |
| 144 | 2571 | UACCAGGCCAUGGCCAAGA | 2719 | UCUUGGCCAUGGCCUGG | Rh, D | [392-410] |
| 145 | 2572 | AAACACCUGGCUGGGCUGA | 2720 | UCAGCCCAGCCAGGUGU | D | [1184-1202] |
| 146 | 2573 | ACCGACGGCAAGCUGCCCA | 2721 | UGGGCAGCUUGCCGUCG | D | [770-788] |
| 147 | 2574 | AACACCUGGCUGGGCUGGA | 2722 | UCCAGCCCAGCCAGGUG | D | [1185-1203] |
| 148 | 2575 | UUCGUGCGCAGCAGCAAGA | 2723 | UCUUGCUGCUGCGCACG | Rh, D, M | [665-683] |

EXAMPLE 10

Animal Models

Model Systems of Fibrotic Conditions

Testing the active siRNAs of the invention may be done in predictive animal models. Rat diabetic and aging models of kidney fibrosis include Zucker diabetic fatty (ZDF) rats, aged fa/fa (obese Zucker) rats, aged Sprague-Dawley (SD) rats, and Goto Kakizaki (GK) rats; GK rats are an inbred strain derived from Wistar rats, selected for spontaneous development of NIDDM (diabetes type II). Induced models of kidney fibrosis include the permanent unilateral ureteral obstruction (UUO) model which is a model of acute interstitial fibrosis occurring in healthy non-diabetic animals; renal fibrosis develops within days following the obstruction. Another induced model of kidney fibrosis is 5/6 nephrectomy.

Two models of liver fibrosis in rats are the Bile Duct Ligation (BDL) with sham operation as controls, and CCl4 poisoning, with olive oil fed animals as controls, as described in the following references: Lotersztajn S, et al Hepatic Fibrosis: Molecular Mechanisms and Drug Targets. Annu Rev Pharmacol Toxicol. 2004 Oct. 7; Uchio K, et al., Down-regulation of connective tissue growth factor and type I collagen mRNA expression by connective tissue growth factor antisense oligonucleotide during experimental liver fibrosis. Wound Repair Regen. 2004 January-February; 12 (1):60-6; Xu X Q, et al., Molecular classification of liver cirrhosis in a rat model by proteomics and bioinformatics Proteomics. 2004 October; 4 (10):3235-45.

Models for ocular scarring are well known in the art e.g. Sherwood M B et al., J. Glaucoma. 2004 October; 13 (5):407-12. A new model of glaucoma filtering surgery in the rat; Miller M H et al., Ophthalmic Surg. 1989 May; 20(5):350-7. Wound healing in an animal model of glaucoma fistulizing surgery in the Rb; vanBockxmeer F M et al., Retina. 1985 Fall-Winter; 5 (4): 239-52. Models for assessing scar tissue inhibitors; Wiedemann P et al., J Pharmacol Methods. 1984 August; 12 (1): 69-78. Proliferative vitreoretinopathy: the Rb cell injection model for screening of antiproliferative drugs.

Models of cataract are described in the following publications: The role of Src family kinases in cortical cataract formation. Zhou J, Menko A S. Invest Ophthalmol V is Sci. 2002 July; 43 (7):2293-300; Bioavailability and anticataract effects of a topical ocular drug delivery system containing disulfuram and hydroxypropyl-beta-cyclodextrin on selenite-treated rats. Wang S, et al. http://www.ncbi.nlm.nih.gov/entrez/query.fcgi?cmd=Retrieve&db=pubmed&dopt=bstract&list_uids=15370367 Curr Eye Res. 2004 July; 29 (1):51-8; and Long-term organ culture system to study the effects of UV-A irradiation on lens transglutaminase. Weinreb O, Dovrat A.; Curr Eye Res. 2004 July; 29 (1):51-8.

The compounds of Table A-18 and Table A-19 are tested in these models of fibrotic conditions, in which it is found that they are effective in treating liver fibrosis and other fibrotic conditions.

Model Systems of Glaucoma

Testing the active siRNA of the invention for treating or preventing glaucoma is preformed in rat animal model for optic nerve crush described for example in: Maeda, K. et al., "*A Novel Neuroprotectant against Retinal Ganglion Cell Damage in a Glaucoma Model and an Optic Nerve Crush Model in the rat*", Investigative Ophthalmology and visual Science (IOVS), March 2004, 45(3)851. Specifically, for optic nerve transection the orbital optic nerve (ON) of anesthetized rats is exposed through a supraorbital approach, the meninges severed and all axons in the ON transected by crushing with forceps for 10 seconds, 2 mm from the lamina cribrosa.

Nucleic acid molecules as disclosed herein are tested in this animal model and the results show that these siRNA compounds are useful in treating and/or preventing glaucoma.

Rat Optic Nerve Crush (ONC) Model: Intravitreal siRNA Delivery and Eye Drop Delivery For optic nerve transsection the orbital optic nerve (ON) of anesthetized rats is exposed through a supraorbital approach, the meninges severed and all axons in the ON transected by crushing with forceps for 10 seconds, 2 mm from the lamina cribrosa.

The siRNA compounds are delivered alone or in combination in 5 uL volume (10 ug/uL) as eye drops. Immediately after optic nerve crush (ONC), 20 ug/10 ul test siRNA or 10 ul PBS is administered to one or both eyes of adult Wistar rats and the levels of siRNA taken up into the dissected and snap frozen whole retinae at 5 h and 1 d, and later at 2 d, 4 d, 7 d, 14 d and 21 d post injection is determined. Similar experiments are performed in order to test activity and efficacy of siRNA administered via eye drops.

Model Systems of Ischemia Reperfusion Injury Following Lung Transplantation in Rats Lung ischemia/reperfusion injury is achieved in a rat animal model as described in Mizobuchi et al., The Journal of Heart and Lung Transplantation, Vol 23 No. 7 (2004) and in Kazuhiro Yasufuku et al., Am. J. Respir. Cell Mol Biol, Vol 25, pp 26-34 (2001).

Specifically, after inducing anesthesia with isofluorane, the trachea is cannulated with a 14-gauge Teflon catheter and the rat is mechanically ventilated with rodent ventilator using 100% oxygen, at a rate of 70 breaths per minute and 2 cm H2O of positive end-respiratory pressure. The left pulmonary artery, veins and main stem bronchus are occluded with a Castaneda clamp. During the operation, the lung is kept moist with saline and the incision is covered to minimize evaporative losses. The period of ischemia is 60 minutes long. At the end of the ischemic period the clamp is removed and the lung is allowed to ventilate and reperfuse for further 4 h, 24 h, and 5 d post induction of lung ischemia. At the end of the experiment, the lungs are gently harvested and either frozen for RNA extraction or fixed in glutaraldehyde cocktail for subsequent histological analysis.

The Bleomycin Animal Model as a Model for Idiopathic Pulmonary Fibrosis (IPF).

Testing feasibility of lung and liver delivery of vitamin A-Coatsome formulated siRNA administered by intravenous injection and intratracheal administration of siRNA-vitamin A-Coatsome complex to a healthy mice and bleomycine-treated mice Objective: To test two administration routes for feasibility of vitamin A-Coatsome formulated siRNA delivery to normal and fibrotic mouse lungs. The main hypothesis to be tested in the current study is whether systemic administration of vitamin A-Coatsome formulated modified siRNA provides efficient uptake and cell-specific distribution in the fibrotic and normal mouse lungs. Intratracheal route of vitamin A-Coatsome formulated modified siRNA will be tested in parallel. siRNA detection and cell-specific distribution in the lungs and liver will be performed by in situ hybridization (ISH)

Background: The Bleomycin model of pulmonary fibrosis has been well developed and characterized over the last three decades (Moeller, et al. Int J Biochem Cell Biol, 40:362-382, 2008; Chua et al., Am J Respir Cell Mol Biol 33:9-13, 2005). Histological hallmarks, such as intra-alveolar buds, mural incorporation of collagen and obliteration of alveolar space are present in BLM-treated animals similar to IPF patients. Early studies demonstrated that C57/B1 mice were consistently prone to BLM-induced lung fibrosis, whereas Balb/C mice were inheritantly resistant. Depending on the route of administration, different fibrotic pattern develops. Intratracheal instillation of BLM results in bronchiocentric accentuated fibrosis, whereas intravenous or intraperitoneal administration induces subpleural scarring similar to human disease (Chua et al. ibid). A mouse model of usual interstitial pneumonia (UIP) is used. This model shows a heterogenous distribution of fibroproliferation, distributed mainly subpleurally, forming similar lesions to those observed in the lungs of patients with idiopathic pulmonary fibrsosis (IPF) (Onuma, et al., Tohoku J Exp Med 194: 147-156, 2001 and Yamaguchi and Ruoslahti, Nature 336: 244-246, 1988). UIP will be induced by intraperitoneal injection of bleomycin every other day for 7 days for a constant composition of subpleural fibroproliferation in the mouse lung (Swiderski et al. Am J Pathol 152: 821-828, 1998 and Shimizukawa et al., Am J Physiol Lung Cell Mol Physiol 284: L526-L532, 2003).

As was previously demonstrated, vitamin A-loaded liposomes containing siRNA interact with retinol-binding protein (RBP) and provide efficient delivery to the hepatic stellate cells via RBP receptor (Sato et al. Nat Biotechnol 26:431-442, 2008). This study is planned to test whether vitA-Coatsome-siRNA complex will be efficiently taken up by an RBP receptor-expressing activated myofibroblasts in the lungs of bleomycin-treated mice. In addition, local administration route (intratracheal instillation) will be tested.

General Study Design
Mice—C57 B1 male
Starting N (BLM I.P.)—40 (6 for the first pilot group, 34 for the study, taling in consideration anticipated 25% mortality)
Starting N (Total)—60
Test siRNA: SERPINHI compounds disclosed herein.

| No | BLM dose, mg/kg BW, in 0.1 ml saline | BLM adm. route | BLM regime | siRNA dose, mg/kg BW | siRNA adm route | siRNA regime | Termination, post last siRNA adm | N (before siRNA administration) |
|---|---|---|---|---|---|---|---|---|
| | | | | | Groups: | | | |
| 1 | 0.75 | I.P. | dd 0, 2, 4, 6 | 4.5 | I.V. | 2 daily | 2 h | 4 |
| 2 | 0.75 | I.P. | dd 0, 2, 4, 6 | 4.5 | I.V. | 2 daily | 24 h | 4 |
| 3 | 0.75 | I.P. | dd 0, 2, 4, 6 | 2.25 | I.T. | 2 daily | 2 h | 4 |
| 4 | 0.75 | I.P. | dd 0, 2, 4, 6 | 2.25 | I.T. | 2 daily | 24 h | 4 |
| 5 | | intact | n/a | 4.5 | I.V. | 2 daily | 2 h | 4 |
| 6 | | intact | n/a | 4.5 | I.V | 2 daily | 24 h | 4 |
| 7 | | intact | n/a | 2.25 | I.T | 2 daily | 2 h | 4 |
| 8 | | intact | n/a | 2.25 | I.T. | 2 daily | 24 h | 4 |
| 9 | 0.75 | I.P. | dd 0, 2, 4, 6 | n/a | I.V. vehicle | 2 daily | 2 h | 3 |
| 10 | 0.75 | I.P. | dd 0, 2, 4, 6 | n/a | I/T/vehicle | 2 daily | 24 h | 3 |
| 11 | | Intact | n/a | n/a | intact | n/a | Any time | 3 |

Bleomycin-induced pulmonary fibrosis. Pulmonary fibrosis of 12-wk-old female C57BL/6 mice will be induced by intraperitoneal instillation of bleomycin chlorate: 0.75 mg/kg body weight dissolved in 0.1 ml of saline every other day for 7 days, on days 0, 2, 4, and 6.

Model follow up and monitoring. The mice will be weighed before the BLM treatment, and twice weekly for the period of study duration.

Pilot evaluation of the establishment of fibrosis. The mice (N=30) are subjected to BLM treatment in groups, to allow for a one week time interval between the first treated group (N=5) and the rest of the animals. On day 14, two mice from the first group are sacrificed and the lungs harvested for the fast HE stain and quick histopathological evaluation of fibrosis. When lung fibrosis is confirmed, the remaining rats are sorted into the groups and treated with siRNA on Day 14 after the first BLM treatment. In case that no sufficient fibrosis develops in the lungs by day 14, the remaining mice from the first treated group are sacrificed on day 21, followed by quick histopathology evaluation of fibrosis. The rest of the animals are treated with test siRNA complex starting from day 21 after the BLM treatment.

siRNA administration. On day 14 or day 21 after the first BLM administration (TBD during the study, based on pilot evaluation of establishment of fibrosis), the animals are group sorted, according to BW. The animals from groups 1 and 2 are administered intravenously (tail vein injection) with siRNA/vitA/Coatsome complex, at an siRNA concentration of 4.5 mg/kg BW. Intact animals of the same age (Groups 5 and 6) are treated in the same manner. BLM treated animals (Group 9) will be used as vitA-coatsome vehicle control). In 24 hours, the injection is repeated to all the animals, as above.

The BLM animals from the groups 3 and 4, and intact mice from groups 7 and 8 are anesthetized with isoflurane and subjected to intratracheal instillation of 2.25 mg/kg BW siRNA formulated in vitA-loaded liposomes. Mice from the BLM group 10 are administered with vitA/Coatsome vehicle only. The inttratracheal instillation is repeated after 24 hours.

Study termination. The animals from the groups 1, 3, 5, 7, 9 are sacrificed at 2 hours after the second siRNA complex injection or instillation. The animals from the groups 2, 4, 6, 8, 10 are sacrificed at 24 hours after the second siRNA complex injection or instillation.

Upon animals sacrifice, the mice are perfused transcardially with 10% neutral buffered formalin. The lungs are inflated with 0.8-1.0 ml of 10% NBF, and the trachea ligated. The lungs are excised and fixed for 24 h in 10% NBF. The liver is harvested from each animal and fixed in 10% NBF for 24 h.

Sectioning and evaluation. Consequent sections are prepared from the lungs and livers. First consequent section are stained with hematoxylin and eosin for assessment of lung and liver morphology, second section are stained with Sirius Red (trichrome) to identify collagen The third consequent sections are subjected to in situ hybridization (ISH) for detection of siRNA.

The compounds as described herein are tested in this animal model and the results show that these siRNA compounds are useful in treating and/or preventing ischemia reperfusion injury following lung transplantation.

TABLE 1

List of siRNA sequences

| siRNA | Target region | Base sequence [corresponding nucleotides of SEQ ID NO: 1] | Experimental sequence [corresponding nucleotides of SEQ ID NO: 1] |
|---|---|---|---|
| siHSP47-C | human/rat sense hsp47 | 5' GGACAGGCCUCUACAACUAUU (SEQ ID NO: 3) [945-963] | 5' GGACAGGCCUCUACAACUAdTdT (SEQ ID NO: 5) [945-963] |

TABLE 1-continued

List of siRNA sequences

| siRNA | Target region | | Base sequence [corresponding nucleotides of SEQ ID NO: 1] | Experimental sequence [corresponding nucleotides of SEQ ID NO: 1] |
|---|---|---|---|---|
| | | anti-sense | 5' UAGUUGUAGAGGCCUGUCCUU (SEQ ID NO: 4) [945-963] | 5' UAGUUGUAGAGGCCUGUCCdTdT (SEQ ID NO: 6) [945-963] |
| siHSP47-Cd | human/rat hsp47 | sense | 5' GGACAGGCCUCUACAACUACUACGA (SEQ ID NO: 7) [945-969] | 5' GGACAGGCCUCUACAACUACUACdGdA (SEQ ID NO: 9) [945-969] |
| | | anti-sense | 5' UCGUAGUAGUUGUAGAGGCCUGUCCUU (SEQ ID NO: 8) [945-969] | 5' UCGUAGUAGUUGUAGAGGCCUGUCCUU (SEQ ID NO: 10) [945-969] |
| siHSP47-1 | human/rat hsp47 | sense | 5' CAGGCCUCUACAACUACUAUU (SEQ ID NO: 11) [948-966] | 5' CAGGCCUCUACAACUACUAdTdT (SEQ ID NO: 13) [948-966] |
| | | anti-sense | 5' UAGUAGUUGUAGAGGCCUGUU (SEQ ID NO: 12) [948-966] | 5' UAGUAGUUGUAGAGGCCUGdTdT (SEQ ID NO: 14) [948-966] |
| siHSP47-1d | human hsp47 | sense | 5' CAGGCCUCUACAACUACUACGACGA (SEQ ID NO: 15) [948-972] | 5' CAGGCCUCUACAACUACUACGACdGdA (SEQ ID NO: 17) [948-972] |
| | | anti-sense | 5' UCGUCGUAGUAGUUGUAGAGGCCUGUU (SEQ ID NO: 16) [948-972] | 5' UCGUCGUAGUAGUUGUAGAGGCCUGUU (SEQ ID NO: 18) [948-972] |
| siHsp47-2 | human hsp47 | sense | 5' GAGCACUCCAAGAUCAACUUU (SEQ ID NO: 19) [698-717] | 5' GAGCACUCCAAGAUCAACUdTdT (SEQ ID NO: 21) [698-717] |
| | | anti-sense | 5' AGUUGAUCUUGGAGUGCUCUU (SEQ ID NO: 20) [698-716] | 5' AGUUGAUCUUGGAGUGCUCdTdT (SEQ ID NO: 22) [698-716] |
| siHsp47-2d | human hsp47 | sense | 5' GAGCACUCCAAGAUCAACUUCCGCG (SEQ ID NO: 23) [698-722] | 5' GAGCACUCCAAGAUCAACUUCCGdCdG (SEQ ID NO: 25) [698-722] |
| | | anti-sense | 5' CGCGGAAGUUGAUCUUGGAGUGCUCUU (SEQ ID NO: 24) [698-722] | 5' CGCGGAAGUUGAUCUUGGAGUGCUCUU (SEQ ID NO: 26) [698-722] |
| siHsp47-2d rat | rat Gp46 | sense | 5' GAACACUCCAAGAUCAACUUCCGAG (SEQ ID NO: 27) [587-611] | 5' GAACACUCCAAGAUCAACUUCCGdAdG (SEQ ID NO: 29) [587-611] |
| | | anti-sense | 5' CUCGGAAGUUGAUCUUGGAGUGUUCUU (SEQ ID NO: 28) [587-611] | 5' CUCGGAAGUUGAUCUUGGAGUGUUCUU (SEQ ID NO: 30) [587-611] |
| siHsp47-3 | human hsp47 | sense | 5' CUGAGGCCAUUGACAAGAAUU (SEQ ID NO: 31) [1209-1227] | 5' CUGAGGCCAUUGACAAGAAdTdT (SEQ ID NO: 33) [1209-1227] |
| | | anti-sense | 5' UUCUUGUCAAUGGCCUCAGUU (SEQ ID NO: 32) [1209-1227] | 5' UUCUUGUCAAUGGCCUCAGdTdT (SEQ ID NO: 34) [1209-1227] |
| siHsp47-3d | human hsp47 | sense | 5' CUGAGGCCAUUGACAAGAACAAGGC (SEQ ID NO: 35) [1209-1233] | 5' CUGAGGCCAUUGACAAGAACAAGdGdC (SEQ ID NO: 37) [1209-1233] |
| | | anti-sense | 5' GCCUUGUUCUUGUCAAUGGCCUCAGUU (SEQ ID NO: 36) [1209-1233] | 5' GCCUUGUUCUUGUCAAUGGCCUCAGUU (SEQ ID NO: 38) [1209-1233] |
| siHsp47-4 | human hsp47 | sense | 5' CUACGACGACGAGAAGGAAUU (SEQ ID NO: 39) [964-982] | 5' CUACGACGACGAGAAGGAAdTdT (SEQ ID NO: 41) [964-982] |
| | | anti-sense | 5' UUCCUUCUCGUCGUCGUAGUU (SEQ ID NO: 40) [964-982] | 5' UUCCUUCUCGUCGUCGUAGdTdT (SEQ ID NO: 42) [964-982] |

TABLE 1-continued

List of siRNA sequences

| siRNA | Target region | | Base sequence [corresponding nucleotides of SEQ ID NO: 1] | Experimental sequence [corresponding nucleotides of SEQ ID NO: 1] |
|---|---|---|---|---|
| siHsp47-4d | human hsp47 | sense | 5' CUACGACGACGAGAAGGAAAAGCUG (SEQ ID NO: 43) [964-988] | 5' CUACGACGACGAGAAGGAAAAGCdTdG (SEQ ID NO: 45) [964-988] |
| | | anti-sense | 5' CAGCUUUUCCUUCUCGUCGUCGUAGUU (SEQ ID NO: 44) [964-988] | 5' CAGCUUUUCCUUCUCGUCGUCGUAGUU (SEQ ID NO: 46) [964-988] |
| siHsp47-5 | human hsp47 | sense | 5' GCCACACUGGGAUGAGAAAUU (SEQ ID NO: 47) [850-870] | 5' GCCACACUGGGAUGAGAAAdTdT (SEQ ID NO: 49) [850-870] |
| | | anti-sense | 5' UUUCUCAUCCCAGUGUGGCUU (SEQ ID NO: 48) [850-868] | 5' UUUCUCAUCCCAGUGUGGCdTdT (SEQ ID NO: 50) [850-868] |
| siHsp47-6 | human hsp47 | sense | 5' GCAGCAAGCAGCACUACAAUU (SEQ ID NO: 51) [675-693] | 5' GCAGCAAGCAGCACUACAAdTdT (SEQ ID NO: 53) [675-693] |
| | | anti-sense | 5' UUGUAGUGCUGCUUGCUGCUU (SEQ ID NO: 52) [675-693] | 5' UUGUAGUGCUGCUUGCUGCdTdT (SEQ ID NO: 54) [675-693] |
| siHsp47-7 | human hsp47 | sense | 5' CCGUGGGUGUCAUGAUGAUUU (SEQ ID NO: 55) [921-939] | 5' CCGUGGGUGUCAUGAUGAUdTdT (SEQ ID NO: 57) [921-939] |
| | | anti-sense | 5' AUCAUCAUGACACCCACGGUU (SEQ ID NO: 56) [921-939] | 5' AUCAUCAUGACACCCACGGdTdT (SEQ ID NO: 58) [921-939] |

The contents of the articles, patents, and patent applications, and all other documents and electronically available information mentioned or cited herein, are hereby incorporated by reference in their entirety to the same extent as if each individual publication was specifically and individually indicated to be incorporated by reference.

Applicants reserve the right to physically incorporate into this application any and all materials and information from any such articles, patents, patent applications, or other physical and electronic documents.

It will be readily apparent to one skilled in the art that varying substitutions and modifications can be made to the invention disclosed herein without departing from the scope and spirit of the invention. Thus, such additional embodiments are within the scope of the present invention and the following claims. The present invention teaches one skilled in the art to test various combinations and/or substitutions of chemical modifications described herein toward generating nucleic acid constructs with improved activity for mediating RNAi activity. Such improved activity can include improved stability, improved bioavailability, and/or improved activation of cellular responses mediating RNAi. Therefore, the specific embodiments described herein are not limiting and one skilled in the art can readily appreciate that specific combinations of the modifications described herein can be tested without undue experimentation toward identifying nucleic acid molecules with improved RNAi activity.

The inventions illustratively described herein may suitably be practiced in the absence of any element or elements, limitation or limitations, not specifically disclosed herein. Thus, for example, the terms "a" and "an" and "the" and similar referents in the context of describing the invention (especially in the context of the following claims) are to be construed to cover both the singular and the plural, unless otherwise indicated herein or clearly contradicted by context. The terms "comprising", "having," "including," containing", etc. shall be read expansively and without limitation (e.g., meaning "including, but not limited to,"). Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention. Additionally, the terms and expressions employed herein have been used as terms of description and not of limitation, and there is no intention in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments and optional features, modification and variation of the inventions embodied therein herein disclosed may be resorted to by those skilled in the art, and that such modifications and variations are considered to be within the scope of this invention.

The invention has been described broadly and generically herein. Each of the narrower species and subgeneric groupings falling within the generic disclosure also form part of the invention. This includes the generic description of the invention with a proviso or negative limitation removing any subject matter from the genus, regardless of whether or not the excised material is specifically recited herein. Other embodiments are within the following claims. In addition, where features or aspects of the invention are described in terms of Markush groups, those skilled in the art will recognize that the invention is also thereby described in terms of any individual member or subgroup of members of the Markush group.

SEQUENCE LISTING (2845 sequences)

SEQ ID NO: 1 - RNA, 2208 nt, Homo sapiens
ucuuuggcuuuuuuuggcggagcuggggcgcccuccggaagcguuuccaacuuuccagaaguuucucgggacgggcaggaggggguggggacugccauauauagaucccgggagcaggggagcgggcuaagaguagaaucgugucgcggcucgagagcgagagucacgucccggcgcuagcccagcccgacccaggcccaccguggugcacgcaaaccacuuccuggccaugcgcucccuccugcuucucagcgccuucugccuccuggaggcggcccuggccgccgaggugaagaaaccugcagccgcagcagcuccuggcacugcggagaaguugagccccaaggcggccacgcuugccgagcgcagcgccggccuggccuucagcuuguaccaggccauggccaaggaccaggcaguggagaacauccuggugucacccguggugguggccucgucgcuagggcucgugucgcugggcggcaaggcgaccacggcgucgcaggccaaggcagugcugagcgccgagcagcugcgcgacgaggaggugcacgccggccugggcgagcugcugcgcucacucagcaacuccacggcgcgcaacgugaccuggaagcugggcagccgacuguacggacccagcucagugagcuucgcugaugacuucgugcgcagcagcaagcagcacuacaacugcgagcacuccaagaucaacuuccgcgacaagcgcagcgcgcugcaguccaucaacgagugggccgcgcagaccaccgacggcaagcugcccgaggucaccaaggacguggagcgcacggacggcgcccugcuagucaacgccauguucuucaagccacacugggaugagaaauuccaccacaagaugguggacaaccguggcuucauggugacucgguccuauaccgugggugucaugaugaugcaccggacaggccucuacaacuacuacgacgacgagaaggaaaagcugcaaaucguggagaugccccuggcccacaagcucuccagccucaucauccucaugccccaucacguggagccucucgagcgccuugaaaagcugcuaaccaaagagcagcugaagaucuggauggggaagaugcagaagaaggcuguugccaucuccuugcccaagggugugguggaggugacccaugaccugcagaaacaccuggcugggcugggccugacugaggccauugacaagaacaaggccgacuugucacgcaugucaggcaagaaggaccuguaccuggccagcguguuccacgccaccgccuuugaguuggacacagauggcaaccccuuugaccaggacaucuacgggcgcgaggagcugcgcagccccaagcuguucuacgccgaccaccccuucaucuuccuagugcgggacacccaaagcggcucccugcuauucauugggcgccugguccggccuaagggugacaagaugcgagacgaguuauagggccucagggugcacacaggauggcaggaggcauccaaaggcuccugagacacaugggugcuauugggguugggggggaggugagguaccagccuuggauacuccaugggguggggguggaaaaacagaccgggguucccgugugccugagcggaccuucccagcuagaauucacuccacuuggacaugggccccagauaccaugaugcugagcccggaaacuccacauccugugggaccugggccauagucauucugccugcccugaaagucccagaucaagccugccucaaucaguauucauauuuauagccagguaccuucucaccugugagaccaaauugagcuaggggggucagccagcccucuucugacacuaaaacaccucagcugccuccccagcucuaucccaaccucucccaacuauaaaacuaggugcugcagccccugggaccaggcacccccagaaugaccuggccgcagugaggcggauugagaaggagcucccaggaggggcuucugggcagacucuggucaagaagcaucgugucuggcguuguggggaugaacuuuuuguuuuguuucuuccuuuuuuaguucuucaaagauagggagggaagggggaacaugagccuuuguugcuaucaauccaagaacuuauuuguacauuuuuuuuuucaauaaaacuuuuccaaugacauuuuguuggagcguggaaaaaa

SEQ ID NO: 2 - protein, 418 aa, Homo sapiens
MRSLLLLSAFCLLEAALAAEVKKPAAAAAPGTAEKLSPKAATLAERSAGLAFSLYQAMAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDEKEKLQIVEMPLAHKLSSLIILMPHHVEPLERLEKLLTKEQLKIWMGKMQKKAVAISLPKGVVEVTHDLQKHLAGLGLTEAIDKNKADLSRMSGKKDLYLASVFHATAFELDTDGNPFDQDIYGREELRSPKLFYADHPFIFLVRDTQSGSLLFIGRLVRPKGDKMRDEL

SEQ ID NO: 3 - RNA, 21 nt, Artificial Sequence
  Chemically synthesized
ggacaggccucuacaacuauu

SEQ ID NO: 4 - RNA, 21 nt, Artificial Sequence
  Chemically synthesized
uaguuguagaggccuguccuu

SEQ ID NO: 5 - DNA, 21 bp, Artificial Sequence
  Chemically synthesized
ggacaggccucuacaacuatt

SEQ ID NO: 6 - DNA, 21 bp, Artificial Sequence
  Chemically synthesized
uaguuguagaggccugucctt

SEQ ID NO: 7 - RNA, 25 nt, Artificial Sequence
  Chemically synthesized
ggacaggccucuacaacuacuacga

SEQ ID NO: 8 - RNA, 27 nt, Artificial Sequence
  Chemically synthesized
ucguaguaguuguagaggccuguccuu

SEQ ID NO: 9 - RNA, 27 nt, Artificial Sequence
  Chemically synthesized
ggacaggccucuacaacuacuacdgda

SEQ ID NO: 10 - RNA, 27 nt, Artificial Sequence
  Chemically synthesized
ucguaguaguuguagaggccuguccuu

SEQ ID NO: 11 - RNA, 21 nt, Artificial Sequence
  Chemically synthesized
caggccucuacaacuacuauu

SEQ ID NO: 12 - RNA, 21 nt, Artificial Sequence
  Chemically synthesized
uaguaguuguagaggccuguu

SEQ ID NO: 13 - DNA, 21 bp, Artificial Sequence
  Chemically synthesized
caggccucuacaacuacuatt

SEQ ID NO: 14 - DNA, 21 bp, Artificial Sequence
  Chemically synthesized
uaguaguuguagaggccugtt

SEQ ID NO: 15 - RNA, 25 nt, Artificial Sequence
  Chemically synthesized
caggccucuacaacuacuacgacga

SEQ ID NO: 16 - RNA, 27 nt, Artificial Sequence
  Chemically synthesized
ucgucguaguaguuguagaggccuguu

SEQ ID NO: 17 - RNA, 27 nt, Artificial Sequence
  Chemically synthesized
caggccucuacaacuacuacgacdgda

SEQ ID NO: 18 - RNA, 27 nt, Artificial Sequence
  Chemically synthesized
ucgucguaguaguuguagaggccuguu

SEQ ID NO: 19 - RNA, 21 nt, Artificial Sequence
  Chemically synthesized
gagcacuccaagaucaacuuu

SEQ ID NO: 20 - RNA, 21 nt, Artificial Sequence
  Chemically synthesized
aguugaucuuggagugcucuu

SEQ ID NO: 21 - DNA, 21 bp, Artificial Sequence
  Chemically synthesized
gagcacuccaagaucaacutt

SEQ ID NO: 22 - DNA, 21 bp, Artificial Sequence
  Chemically synthesized
aguugaucuuggagugcuctt

SEQ ID NO: 23 - RNA, 25 nt, Artificial Sequence
  Chemically synthesized
gagcacuccaagaucaacuuccgcg

SEQ ID NO: 24 - RNA, 27 nt, Artificial Sequence
  Chemically synthesized
cgcggaaguugaucuuggagugcucuu

SEQ ID NO: 25 - RNA, 27 nt, Artificial Sequence
  Chemically synthesized
gagcacuccaagaucaacuuccgdcdg

SEQ ID NO: 26 - RNA, 27 nt, Artificial Sequence
  Chemically synthesized
cgcggaaguugaucuuggagugcucuu

SEQ ID NO: 27 - RNA, 25 nt, Artificial Sequence
  Chemically synthesized
gaacacuccaagaucaacuuccgag

SEQ ID NO: 28 - RNA, 27 nt, Artificial Sequence
  Chemically synthesized
cucggaaguugaucuuggaguguucuu

SEQ ID NO: 29 - RNA, 27 nt, Artificial Sequence
  Chemically synthesized
gaacacuccaagaucaacuuccgdadg

SEQ ID NO: 30 - RNA, 27 nt, Artificial Sequence
  Chemically synthesized
cucggaaguugaucuuggaguguucuu

SEQ ID NO: 31 - RNA, 21 nt, Artificial Sequence
  Chemically synthesized
cugaggccauugacaagaauu

SEQ ID NO: 32 - RNA, 21 nt, Artificial Sequence
  Chemically synthesized
uucuugucaauggccucaguu

SEQ ID NO: 33 - DNA, 21 bp, Artificial Sequence
  Chemically synthesized
cugaggccauugacaagaatt

SEQ ID NO: 34 - DNA, 21 bp, Artificial Sequence
  Chemically synthesized
uucuugucaauggccucagtt

SEQ ID NO: 35 - RNA, 25 nt, Artificial Sequence
  Chemically synthesized
cugaggccauugacaagaacaaggc

SEQ ID NO: 36 - RNA, 27 nt, Artificial Sequence
  Chemically synthesized
gccuuguucuugucaauggccucaguu

SEQ ID NO: 37 - RNA, 27 nt, Artificial Sequence
  Chemically synthesized
cugaggccauugacaagaacaagdgdc

SEQ ID NO: 38 - RNA, 27 nt, Artificial Sequence
  Chemically synthesized
gccuuguucuugucaauggccucaguu

SEQ ID NO: 39 - RNA, 21 nt, Artificial Sequence
  Chemically synthesized
cuacgacgacgagaaggaauu

SEQ ID NO: 40 - RNA, 21 nt, Artificial Sequence
  Chemically synthesized
uuccuucucgucgucguaguu

SEQ ID NO: 41 - DNA, 21 bp, Artificial Sequence
  Chemically synthesized
cuacgacgacgagaaggaatt

SEQ ID NO: 42 - DNA, 21 bp, Artificial Sequence
  Chemically synthesized
uuccuucucgucgucguagtt

SEQ ID NO: 43 - RNA, 25 nt, Artificial Sequence
  Chemically synthesized
cuacgacgacgagaaggaaaagcug

SEQ ID NO: 44 - RNA, 27 nt, Artificial Sequence
  Chemically synthesized
cagcuuuuccuucucgucgucguaguu

SEQ ID NO: 45 - DNA, 25 bp, Artificial Sequence
  Chemically synthesized
cuacgacgacgagaaggaaaagctg

SEQ ID NO: 46 - RNA, 27 nt, Artificial Sequence
  Chemically synthesized
cagcuuuuccuucucgucgucguaguu

SEQ ID NO: 47 - RNA, 21 nt, Artificial Sequence
  Chemically synthesized
gccacacugggaugagaaauu

SEQ ID NO: 48 - RNA, 21 nt, Artificial Sequence
  Chemically synthesized
uuucucaucccaguguggcuu

SEQ ID NO: 49 - DNA, 21 bp, Artificial Sequence
  Chemically synthesized
gccacacugggaugagaaatt

SEQ ID NO: 50 - DNA, 21 bp, Artificial Sequence
  Chemically synthesized
uuucucaucccaguguggctt

SEQ ID NO: 51 - RNA, 21 nt, Artificial Sequence
  Chemically synthesized
gcagcaagcagcacuacaauu

SEQ ID NO: 52 - RNA, 21 nt, Artificial Sequence
  Chemically synthesized
uuguagugcugcuugcugcuu

SEQ ID NO: 53 - DNA, 21 bp, Artificial Sequence
  Chemically synthesized
gcagcaagcagcacuacaatt

SEQ ID NO: 54 - DNA, 21 bp, Artificial Sequence
  Chemically synthesized
uuguagugcugcuugcugctt

SEQ ID NO: 55 - RNA, 21 nt, Artificial Sequence
  Chemically synthesized
ccgugggugucaugaugauuu

SEQ ID NO: 56 - RNA, 21 nt, Artificial Sequence
  Chemically synthesized
aucaucaugacacccacgguu

SEQ ID NO: 57 - DNA, 21 bp, Artificial Sequence
  Chemically synthesized
ccgugggugucaugaugautt

SEQ ID NO: 58 - DNA, 21 bp, Artificial Sequence
  Chemically synthesized
aucaucaugacacccacggtt

SEQ ID NO: 59 - RNA, 1244 nt, Artificial Sequence
  Chemically synthesized
augcgcucccuccugcuucucagcgccuucugccuccuggaggcggcccuggccgccgaggugaagaaaccugcagccgcagcagcuccuggcacugcggagaaguugagccccaaggcggccacgcuugccgagcgcagcgccggccuggccuucagcuuguaccaggccauggccaaggaccaggcaguggagaaauccuggugucacccguggugguggccucgucgcuagggcucgugucgcugggcggcaaggcgaccacggcgucgcaggccaaggcagugcugagcgccgagcagcugcgcgacgaggaggugcacgccggcugggcgagcugcugcgcucacucagcaacuccacggcgcgcaacgugaccuggaagcugggcagccacuguacggacccagcucagugagcuucgcugaugacuucgugcgcagcagcaagcagcacuacaaugcgagcacuccaagaucaacuuccgcgacaagcgcagcgcgcugcaguccaucaacgagugggcccgcagaccaccgacggcaagcugcccgaggucaccaaggacguggagcgcacggacggcgcccugcagucaacgccauguucuucaagccacacugggaugagaaauuccaccacaagaugguggacaaccgggcuucauggugacucgguccuauaccgugggugucaugaugaugcaccggacaggccucuacaacacuacgacgacgagaaggaaaagcugcaaaucguggagaugccccuggcccacaagcucuccagccucaucauccucaugccccaucacguggagccucucgagcgccuugaaaagcugcuaaccaaagagcagcugaagaucuggauggggaagaugcagagaaggcuguugccaucuccuugcccaagggugugguggaggugacccaugaccugcagaaacaccggcugggcugggccugacugaggccauugacaagaacaaggccgacuugucacgcaugucaggcaaaaggaccuguaccuggccagcguguuccacgccaccgccuuugaguuggacacagauggcaaccccuuugaccaggacaucuacgggcgcgaggagcugcgcagccccaagcuguucuacgccgaccaccccucaucuuccuagugcgggacacccaaagcggcucccugcuauucauugggcgccugguccggccuagggugacaagaugcgagacgaguuauag

SEQ ID NO: 60 - RNA, 19 nt, Artificial Sequence
  Chemically synthesized
gagacacaugggugcuaua

SEQ ID NO: 61 - RNA, 19 nt, Artificial Sequence
  Chemically synthesized
gggaagaugcagaagaaga

SEQ ID NO: 62 - RNA, 19 nt, Artificial Sequence
  Chemically synthesized
gaagaaggcuguugccaua

SEQ ID NO: 63 - RNA, 19 nt, Artificial Sequence
  Chemically synthesized
acaagaugcgagacgagua

SEQ ID NO: 64 - RNA, 19 nt, Artificial Sequence
  Chemically synthesized
ggacaaccguggcuucaua

SEQ ID NO: 65 - RNA, 19 nt, Artificial Sequence
  Chemically synthesized
ugcaguccaucaacgagua

SEQ ID NO: 66 - RNA, 19 nt, Artificial Sequence
  Chemically synthesized
gccucaucauccucaugca

SEQ ID NO: 67 - RNA, 19 nt, Artificial Sequence
  Chemically synthesized
cgcgcugcaguccaucaaa

SEQ ID NO: 68 - RNA, 19 nt, Artificial Sequence
  Chemically synthesized
cggacaggccucuacaaca

SEQ ID NO: 69 - RNA, 19 nt, Artificial Sequence
  Chemically synthesized
ugacaagaugcgagacgaa

SEQ ID NO: 70 - RNA, 19 nt, Artificial Sequence
  Chemically synthesized
ccagccucaucauccucaa

SEQ ID NO: 71 - RNA, 19 nt, Artificial Sequence
  Chemically synthesized
gcugcaguccaucaacgaa

SEQ ID NO: 72 - RNA, 19 nt, Artificial Sequence
  Chemically synthesized
gcagcgcgcugcaguccaa

SEQ ID NO: 73 - RNA, 19 nt, Artificial Sequence
  Chemically synthesized
ugagacacaugggugcuaa

SEQ ID NO: 74 - RNA, 19 nt, Artificial Sequence
  Chemically synthesized
gguggaggugacccaugaa

SEQ ID NO: 75 - RNA, 19 nt, Artificial Sequence
  Chemically synthesized
cuuugaccaggacaucuaa

SEQ ID NO: 76 - RNA, 19 nt, Artificial Sequence
  Chemically synthesized
ggaggugacccaugaccua

SEQ ID NO: 77 - RNA, 19 nt, Artificial Sequence
  Chemically synthesized
cuccugagacacaugggua

SEQ ID NO: 78 - RNA, 19 nt, Artificial Sequence
  Chemically synthesized
agaagaaggcuguugccaa

SEQ ID NO: 79 - RNA, 19 nt, Artificial Sequence
  Chemically synthesized
agcucuccagccucaucaa

SEQ ID NO: 80 - RNA, 19 nt, Artificial Sequence
  Chemically synthesized
cugcaguccaucaacgaga

SEQ ID NO: 81 - RNA, 19 nt, Artificial Sequence
  Chemically synthesized
ccggacaggccucuacaaa

SEQ ID NO: 82 - RNA, 19 nt, Artificial Sequence
  Chemically synthesized
gcaccggacaggccucuaa

SEQ ID NO: 83 - RNA, 19 nt, Artificial Sequence
  Chemically synthesized
gcagaagaaggcuguugca

SEQ ID NO: 84 - RNA, 19 nt, Artificial Sequence
  Chemically synthesized
agaaggcuguugccaucua

SEQ ID NO: 85 - RNA, 19 nt, Artificial Sequence
  Chemically synthesized
agcgcagcgcgcugcagua

SEQ ID NO: 86 - RNA, 19 nt, Artificial Sequence
  Chemically synthesized
gacacaugggugcuauuga

SEQ ID NO: 87 - RNA, 19 nt, Artificial Sequence
  Chemically synthesized
gggccugacugaggccaua

SEQ ID NO: 88 - RNA, 19 nt, Artificial Sequence
  Chemically synthesized
agacacaugggugcuauua

SEQ ID NO: 89 - RNA, 19 nt, Artificial Sequence
  Chemically synthesized
ccaugaccugcagaaacaa

SEQ ID NO: 90 - RNA, 19 nt, Artificial Sequence
  Chemically synthesized
agaugcagaagaaggcuga

SEQ ID NO: 91 - RNA, 19 nt, Artificial Sequence
  Chemically synthesized
caagcucuccagccucaua

SEQ ID NO: 92 - RNA, 19 nt, Artificial Sequence
  Chemically synthesized
ugcagaagaaggcuguuga

SEQ ID NO: 93 - RNA, 19 nt, Artificial Sequence
  Chemically synthesized
cagccucaucauccucaua

SEQ ID NO: 94 - RNA, 19 nt, Artificial Sequence
  Chemically synthesized
gacaggccucuacaacuaa

SEQ ID NO: 95 - RNA, 19 nt, Artificial Sequence
  Chemically synthesized
gaugcagaagaaggcugua

SEQ ID NO: 96 - RNA, 19 nt, Artificial Sequence
  Chemically synthesized
acccaugaccugcagaaaa

SEQ ID NO: 97 - RNA, 19 nt, Artificial Sequence
  Chemically synthesized
acuccaagaucaacuucca

SEQ ID NO: 98 - RNA, 19 nt, Artificial Sequence
  Chemically synthesized
acuccaagaucaacuuccu

SEQ ID NO: 99 - RNA, 19 nt, Artificial Sequence
  Chemically synthesized
aggccucuacaacuacuaa

SEQ ID NO: 100 - RNA, 19 nt, Artificial Sequence
  Chemically synthesized
cacuccaagaucaacuuca

SEQ ID NO: 101 - RNA, 19 nt, Artificial Sequence
  Chemically synthesized
uccugagacacauggguga

SEQ ID NO: 102 - RNA, 19 nt, Artificial Sequence
  Chemically synthesized
gacaagaugcgagacgaga

SEQ ID NO: 103 - RNA, 19 nt, Artificial Sequence
  Chemically synthesized
ggugacccaugaccugcaa

SEQ ID NO: 104 - RNA, 19 nt, Artificial Sequence
  Chemically synthesized
ccgaggugaagaaaccuga

SEQ ID NO: 105 - RNA, 19 nt, Artificial Sequence
  Chemically synthesized
uccugagacacaugggugu

SEQ ID NO: 106 - RNA, 19 nt, Artificial Sequence
  Chemically synthesized
gcacuccaagaucaacuua

SEQ ID NO: 107 - RNA, 19 nt, Artificial Sequence
  Chemically synthesized
gugguggaggugacccaua

SEQ ID NO: 108 - RNA, 19 nt, Artificial Sequence
  Chemically synthesized
gccgaggugaagaaaccua

SEQ ID NO: 109 - RNA, 19 nt, Artificial Sequence
  Chemically synthesized
gcucuccagccucaucaua

SEQ ID NO: 110 - RNA, 19 nt, Artificial Sequence
  Chemically synthesized
gaugcaccggacaggccua

SEQ ID NO: 111 - RNA, 19 nt, Artificial Sequence
  Chemically synthesized
cucuccagccucaucauca

SEQ ID NO: 112 - RNA, 19 nt, Artificial Sequence
  Chemically synthesized
gcagaccaccgacggcaaa

SEQ ID NO: 113 - RNA, 19 nt, Artificial Sequence
  Chemically synthesized
aguccaucaacgaguggga

SEQ ID NO: 114 - RNA, 19 nt, Artificial Sequence
  Chemically synthesized
accguggcuucauggugaa

SEQ ID NO: 115 - RNA, 19 nt, Artificial Sequence
  Chemically synthesized
gaaggcuguugccaucuca

SEQ ID NO: 116 - RNA, 19 nt, Artificial Sequence
  Chemically synthesized
gaagaugcagaagaaggca

SEQ ID NO: 117 - RNA, 19 nt, Artificial Sequence
  Chemically synthesized
ugaugaugcaccggacaga

SEQ ID NO: 118 - RNA, 19 nt, Artificial Sequence
  Chemically synthesized
cccuuugaccaggacauca

SEQ ID NO: 119 - RNA, 19 nt, Artificial Sequence
  Chemically synthesized
caguccaucaacgagugga

SEQ ID NO: 120 - RNA, 19 nt, Artificial Sequence
  Chemically synthesized
caaccguggcuucauggua

SEQ ID NO: 121 - RNA, 19 nt, Artificial Sequence
  Chemically synthesized
cgacaagcgcagcgcgcua

SEQ ID NO: 122 - RNA, 19 nt, Artificial Sequence
  Chemically synthesized
gcaguccaucaacgaguga

SEQ ID NO: 123 - RNA, 19 nt, Artificial Sequence
  Chemically synthesized
acaggccucuacaacuaca

SEQ ID NO: 124 - RNA, 19 nt, Artificial Sequence
  Chemically synthesized
aagaugcagaagaaggcua

SEQ ID NO: 125 - RNA, 19 nt, Artificial Sequence
  Chemically synthesized
cagcgcgcugcaguccaua

SEQ ID NO: 126 - RNA, 19 nt, Artificial Sequence
  Chemically synthesized
gcgcagcgcgcugcaguca

SEQ ID NO: 127 - RNA, 19 nt, Artificial Sequence
  Chemically synthesized
uauagcacccaugugucuc

SEQ ID NO: 128 - RNA, 19 nt, Artificial Sequence
  Chemically synthesized
ucuucuucugcaucuuccc

SEQ ID NO: 129 - RNA, 19 nt, Artificial Sequence
  Chemically synthesized
uauggcaacagccuucuuc

SEQ ID NO: 130 - RNA, 19 nt, Artificial Sequence
  Chemically synthesized
uacucgucucgcaucuugu

SEQ ID NO: 131 - RNA, 19 nt, Artificial Sequence
  Chemically synthesized
uaugaagccacgguugucc

SEQ ID NO: 132 - RNA, 19 nt, Artificial Sequence
  Chemically synthesized
uacucguugauggacugca

SEQ ID NO: 133 - RNA, 19 nt, Artificial Sequence
  Chemically synthesized
ugcaugaggaugaugaggc

SEQ ID NO: 134 - RNA, 19 nt, Artificial Sequence
  Chemically synthesized
uuugauggacugcagcgcg

SEQ ID NO: 135 - RNA, 19 nt, Artificial Sequence
  Chemically synthesized
uguuguagaggccuguccg

SEQ ID NO: 136 - RNA, 19 nt, Artificial Sequence
  Chemically synthesized
uucgucucgcaucuuguca

SEQ ID NO: 137 - RNA, 19 nt, Artificial Sequence
  Chemically synthesized
uugaggaugaugaggcugg

SEQ ID NO: 138 - RNA, 19 nt, Artificial Sequence
  Chemically synthesized
uucguugauggacugcagc

SEQ ID NO: 139 - RNA, 19 nt, Artificial Sequence
  Chemically synthesized
uuggacugcagcgcgcugc

SEQ ID NO: 140 - RNA, 19 nt, Artificial Sequence
  Chemically synthesized
uuagcacccaugugucuca

SEQ ID NO: 141 - RNA, 19 nt, Artificial Sequence
  Chemically synthesized
uucaugggucaccuccacc

SEQ ID NO: 142 - RNA, 19 nt, Artificial Sequence
  Chemically synthesized
uuagauguccuggucaaag

SEQ ID NO: 143 - RNA, 19 nt, Artificial Sequence
  Chemically synthesized
uaggucaugggucaccucc

SEQ ID NO: 144 - RNA, 19 nt, Artificial Sequence
  Chemically synthesized
uacccaugugucucaggag

SEQ ID NO: 145 - RNA, 19 nt, Artificial Sequence
  Chemically synthesized
uuggcaacagccuucuucu

SEQ ID NO: 146 - RNA, 19 nt, Artificial Sequence
  Chemically synthesized
uugaugaggcuggagagcu

SEQ ID NO: 147 - RNA, 19 nt, Artificial Sequence
  Chemically synthesized
ucucguugauggacugcag

SEQ ID NO: 148 - RNA, 19 nt, Artificial Sequence
  Chemically synthesized
uuuguagaggccuguccgg

SEQ ID NO: 149 - RNA, 19 nt, Artificial Sequence
  Chemically synthesized
uuagaggccuguccggugc

SEQ ID NO: 150 - RNA, 19 nt, Artificial Sequence
  Chemically synthesized
ugcaacagccuucuucugc

SEQ ID NO: 151 - RNA, 19 nt, Artificial Sequence
  Chemically synthesized
uagauggcaacagccuucu

SEQ ID NO: 152 - RNA, 19 nt, Artificial Sequence
  Chemically synthesized
uacugcagcgcgcugcgcu

SEQ ID NO: 153 - RNA, 19 nt, Artificial Sequence
  Chemically synthesized
ucaauagcacccauguguc

SEQ ID NO: 154 - RNA, 19 nt, Artificial Sequence
  Chemically synthesized
uauggccucagucaggccc

SEQ ID NO: 155 - RNA, 19 nt, Artificial Sequence
  Chemically synthesized
uaauagcacccaugugucu

SEQ ID NO: 156 - RNA, 19 nt, Artificial Sequence
  Chemically synthesized
uuguuucugcaggucaugg

SEQ ID NO: 157 - RNA, 19 nt, Artificial Sequence
  Chemically synthesized
ucagccuucuucugcaucu

SEQ ID NO: 158 - RNA, 19 nt, Artificial Sequence
  Chemically synthesized
uaugaggcuggagagcuug

SEQ ID NO: 159 - RNA, 19 nt, Artificial Sequence
  Chemically synthesized
ucaacagccuucuucugca

SEQ ID NO: 160 - RNA, 19 nt, Artificial Sequence
  Chemically synthesized
uaugaggaugaugaggcug

SEQ ID NO: 161 - RNA, 19 nt, Artificial Sequence
  Chemically synthesized
uuaguuguagaggccuguc

SEQ ID NO: 162 - RNA, 19 nt, Artificial Sequence
  Chemically synthesized
uacagccuucuucugcauc

SEQ ID NO: 163 - RNA, 19 nt, Artificial Sequence
  Chemically synthesized
uuuucugcaggucaugggu

SEQ ID NO: 164 - RNA, 19 nt, Artificial Sequence
  Chemically synthesized
uggaaguugaucuuggagu

SEQ ID NO: 165 - RNA, 19 nt, Artificial Sequence
  Chemically synthesized
aggaaguugaucuuggagu

SEQ ID NO: 166 - RNA, 19 nt, Artificial Sequence
  Chemically synthesized
uuaguaguuguagaggccu

SEQ ID NO: 167 - RNA, 19 nt, Artificial Sequence
  Chemically synthesized
ugaaguugaucuuggagug

SEQ ID NO: 168 - RNA, 19 nt, Artificial Sequence
  Chemically synthesized
ucacccaugugucucagga

SEQ ID NO: 169 - RNA, 19 nt, Artificial Sequence
  Chemically synthesized
ucucgucucgcaucuuguc

SEQ ID NO: 170 - RNA, 19 nt, Artificial Sequence
  Chemically synthesized
uugcaggucaugggucacc

SEQ ID NO: 171 - RNA, 19 nt, Artificial Sequence
  Chemically synthesized
ucagguuucuucaccucgg

SEQ ID NO: 172 - RNA, 19 nt, Artificial Sequence
  Chemically synthesized
acacccaugugucucagga

SEQ ID NO: 173 - RNA, 19 nt, Artificial Sequence
  Chemically synthesized
uaaguugaucuuggagugc

SEQ ID NO: 174 - RNA, 19 nt, Artificial Sequence
  Chemically synthesized
uaugggucaccuccaccac

SEQ ID NO: 175 - RNA, 19 nt, Artificial Sequence
  Chemically synthesized
uagguuucuucaccucggc

SEQ ID NO: 176 - RNA, 19 nt, Artificial Sequence
  Chemically synthesized
uaugaugaggcuggagagc

SEQ ID NO: 177 - RNA, 19 nt, Artificial Sequence
  Chemically synthesized
uaggccuguccggugcauc

SEQ ID NO: 178 - RNA, 19 nt, Artificial Sequence
  Chemically synthesized
ugaugaugaggcuggagag

SEQ ID NO: 179 - RNA, 19 nt, Artificial Sequence
  Chemically synthesized
uuugccgucgguggucugc

SEQ ID NO: 180 - RNA, 19 nt, Artificial Sequence
  Chemically synthesized
ucccacucguugauggacu

SEQ ID NO: 181 - RNA, 19 nt, Artificial Sequence
  Chemically synthesized
uucaccaugaagccacggu

SEQ ID NO: 182 - RNA, 19 nt, Artificial Sequence
  Chemically synthesized
ugagauggcaacagccuuc

SEQ ID NO: 183 - RNA, 19 nt, Artificial Sequence
  Chemically synthesized
ugccuucuucugcaucuuc

SEQ ID NO: 184 - RNA, 19 nt, Artificial Sequence
  Chemically synthesized
ucuguccggugcaucauca

SEQ ID NO: 185 - RNA, 19 nt, Artificial Sequence
  Chemically synthesized
ugauguccuggucaaaggg

SEQ ID NO: 186 - RNA, 19 nt, Artificial Sequence
  Chemically synthesized
uccacucguugauggacug

SEQ ID NO: 187 - RNA, 19 nt, Artificial Sequence
  Chemically synthesized
uaccaugaagccacgguug

SEQ ID NO: 188 - RNA, 19 nt, Artificial Sequence
  Chemically synthesized
uagcgcgcugcgcuugucg

SEQ ID NO: 189 - RNA, 19 nt, Artificial Sequence
  Chemically synthesized
ucacucguugauggacugc

SEQ ID NO: 190 - RNA, 19 nt, Artificial Sequence
  Chemically synthesized
uguaguuguagaggccugu

SEQ ID NO: 191 - RNA, 19 nt, Artificial Sequence
  Chemically synthesized
uagccuucuucugcaucuu

SEQ ID NO: 192 - RNA, 19 nt, Artificial Sequence
  Chemically synthesized
uauggacugcagcgcgcug

SEQ ID NO: 193 - RNA, 19 nt, Artificial Sequence
  Chemically synthesized
ugacugcagcgcgcugcgc

SEQ ID NO: 194 - RNA, 19 nt, Artificial Sequence
  Chemically synthesized
ggacaggccucuacaacua

SEQ ID NO: 195 - RNA, 19 nt, Artificial Sequence
  Chemically synthesized
gagacacaugggugcuauu

SEQ ID NO: 196 - RNA, 19 nt, Artificial Sequence
  Chemically synthesized
acaagaugcgagacgaguu

SEQ ID NO: 197 - RNA, 19 nt, Artificial Sequence
  Chemically synthesized
ccuuugaccaggacaucua

SEQ ID NO: 198 - RNA, 19 nt, Artificial Sequence
  Chemically synthesized
gacccaugaccugcagaaa

SEQ ID NO: 199 - RNA, 19 nt, Artificial Sequence
  Chemically synthesized
cggacaggccucuacaacu

SEQ ID NO: 200 - RNA, 19 nt, Artificial Sequence
  Chemically synthesized
accggacaggccucuacaa

SEQ ID NO: 201 - RNA, 19 nt, Artificial Sequence
  Chemically synthesized
gcagcgcgcugcaguccau

SEQ ID NO: 202 - RNA, 19 nt, Artificial Sequence
  Chemically synthesized
gcgcgcugcaguccaucaa

SEQ ID NO: 203 - RNA, 19 nt, Artificial Sequence
  Chemically synthesized
cugagacacaugggugcua

SEQ ID NO: 204 - RNA, 19 nt, Artificial Sequence
  Chemically synthesized
agaagaaggcuguugccau

SEQ ID NO: 205 - RNA, 19 nt, Artificial Sequence
  Chemically synthesized
agcucuccagccucaucau

SEQ ID NO: 206 - RNA, 19 nt, Artificial Sequence
  Chemically synthesized
cugcaguccaucaacgagu

SEQ ID NO: 207 - RNA, 19 nt, Artificial Sequence
  Chemically synthesized
cgcugcaguccaucaacga

SEQ ID NO: 208 - RNA, 19 nt, Artificial Sequence
  Chemically synthesized
gacaagaugcgagacgagu

SEQ ID NO: 209 - RNA, 19 nt, Artificial Sequence
  Chemically synthesized
gggccugacugaggccauu

SEQ ID NO: 210 - RNA, 19 nt, Artificial Sequence
  Chemically synthesized
gaugcagaagaaggcuguu

SEQ ID NO: 211 - RNA, 19 nt, Artificial Sequence
  Chemically synthesized
caccggacaggccucuaca

SEQ ID NO: 212 - RNA, 19 nt, Artificial Sequence
  Chemically synthesized
agaugcagaagaaggcugu

SEQ ID NO: 213 - RNA, 19 nt, Artificial Sequence
  Chemically synthesized
agcgcgcugcaguccauca

SEQ ID NO: 214 - RNA, 19 nt, Artificial Sequence
  Chemically synthesized
ggaagaugcagaagaaggc

SEQ ID NO: 215 - RNA, 19 nt, Artificial Sequence
  Chemically synthesized
gaagaaggcuguugccauc

SEQ ID NO: 216 - RNA, 19 nt, Artificial Sequence
  Chemically synthesized
ugcaguccaucaacgagug

SEQ ID NO: 217 - RNA, 19 nt, Artificial Sequence
  Chemically synthesized
ccugagacacaugggugcu

SEQ ID NO: 218 - RNA, 19 nt, Artificial Sequence
  Chemically synthesized
cgcagcgcgcugcagucca

SEQ ID NO: 219 - RNA, 19 nt, Artificial Sequence
  Chemically synthesized
uaguuguagaggccugucc

SEQ ID NO: 220 - RNA, 19 nt, Artificial Sequence
  Chemically synthesized
aauagcacccaugugucuc

SEQ ID NO: 221 - RNA, 19 nt, Artificial Sequence
  Chemically synthesized
aacucgucucgcaucuugu

SEQ ID NO: 222 - RNA, 19 nt, Artificial Sequence
  Chemically synthesized
uagauguccuggucaaagg

SEQ ID NO: 223 - RNA, 19 nt, Artificial Sequence
  Chemically synthesized
uuucugcaggucauggguc

SEQ ID NO: 224 - RNA, 19 nt, Artificial Sequence
  Chemically synthesized
aguuguagaggccuguccg

SEQ ID NO: 225 - RNA, 19 nt, Artificial Sequence
  Chemically synthesized
uuguagaggccuguccggu

SEQ ID NO: 226 - RNA, 19 nt, Artificial Sequence
  Chemically synthesized
auggacugcagcgcgcugc

SEQ ID NO: 227 - RNA, 19 nt, Artificial Sequence
  Chemically synthesized
uugauggacugcagcgcgc

SEQ ID NO: 228 - RNA, 19 nt, Artificial Sequence
  Chemically synthesized
uagcacccaugugucucag

SEQ ID NO: 229 - RNA, 19 nt, Artificial Sequence
  Chemically synthesized
auggcaacagccuucuucu

SEQ ID NO: 230 - RNA, 19 nt, Artificial Sequence
  Chemically synthesized
augaugaggcuggagagcu

SEQ ID NO: 231 - RNA, 19 nt, Artificial Sequence
  Chemically synthesized
acucguugauggacugcag

SEQ ID NO: 232 - RNA, 19 nt, Artificial Sequence
  Chemically synthesized
ucguugauggacugcagcg

SEQ ID NO: 233 - RNA, 19 nt, Artificial Sequence
  Chemically synthesized
acucgucucgcaucuuguc

SEQ ID NO: 234 - RNA, 19 nt, Artificial Sequence
  Chemically synthesized
aauggccucagucaggccc

SEQ ID NO: 235 - RNA, 19 nt, Artificial Sequence
  Chemically synthesized
aacagccuucuucugcauc

SEQ ID NO: 236 - RNA, 19 nt, Artificial Sequence
  Chemically synthesized
uguagaggccuguccggug

SEQ ID NO: 237 - RNA, 19 nt, Artificial Sequence
  Chemically synthesized
acagccuucuucugcaucu

SEQ ID NO: 238 - RNA, 19 nt, Artificial Sequence
  Chemically synthesized
ugauggacugcagcgcgcu

SEQ ID NO: 239 - RNA, 19 nt, Artificial Sequence
  Chemically synthesized
gccuucuucugcaucuucc

SEQ ID NO: 240 - RNA, 19 nt, Artificial Sequence
  Chemically synthesized
gauggcaacagccuucuuc

SEQ ID NO: 241 - RNA, 19 nt, Artificial Sequence
  Chemically synthesized
cacucguugauggacugca

SEQ ID NO: 242 - RNA, 19 nt, Artificial Sequence
  Chemically synthesized
agcacccaugugucucagg

SEQ ID NO: 243 - RNA, 19 nt, Artificial Sequence
  Chemically synthesized
uggacugcagcgcgcugcg

SEQ ID NO: 244 - RNA, 19 nt, Artificial Sequence
  Chemically synthesized
ggcagacucuggucaagaa

SEQ ID NO: 245 - RNA, 19 nt, Artificial Sequence
  Chemically synthesized
cagugaggcggauugagaa

SEQ ID NO: 246 - RNA, 19 nt, Artificial Sequence
  Chemically synthesized
agccuuuguugcuaucaau

SEQ ID NO: 247 - RNA, 19 nt, Artificial Sequence
  Chemically synthesized
ccauguucuucaagccaca

SEQ ID NO: 248 - RNA, 19 nt, Artificial Sequence
  Chemically synthesized
cccucuucugacacuaaaa

SEQ ID NO: 249 - RNA, 19 nt, Artificial Sequence
  Chemically synthesized
ccucaaucaguauucauau

SEQ ID NO: 250 - RNA, 19 nt, Artificial Sequence
  Chemically synthesized
gagacacaugggugcuauu

SEQ ID NO: 251 - RNA, 19 nt, Artificial Sequence
  Chemically synthesized
gugacaagaugcgagacga

SEQ ID NO: 252 - RNA, 19 nt, Artificial Sequence
  Chemically synthesized
gccacacugggaugagaaa

SEQ ID NO: 253 - RNA, 19 nt, Artificial Sequence
  Chemically synthesized
agaugcgagacgaguuaua

SEQ ID NO: 254 - RNA, 19 nt, Artificial Sequence
  Chemically synthesized
acgacgacgagaaggaaaa

SEQ ID NO: 255 - RNA, 19 nt, Artificial Sequence
  Chemically synthesized
gccucuacaacuacuacga

SEQ ID NO: 256 - RNA, 19 nt, Artificial Sequence
  Chemically synthesized
agaucaacuuccgcgacaa

SEQ ID NO: 257 - RNA, 19 nt, Artificial Sequence
  Chemically synthesized
acuacuacgacgacgagaa

SEQ ID NO: 258 - RNA, 19 nt, Artificial Sequence
  Chemically synthesized
agcccucuucugacacuaa

SEQ ID NO: 259 - RNA, 19 nt, Artificial Sequence
  Chemically synthesized
acaagaugcgagacgaguu

SEQ ID NO: 260 - RNA, 19 nt, Artificial Sequence
  Chemically synthesized
agccacacugggaugagaa

SEQ ID NO: 261 - RNA, 19 nt, Artificial Sequence
  Chemically synthesized
aggaccaggcaguggagaa

SEQ ID NO: 262 - RNA, 19 nt, Artificial Sequence
  Chemically synthesized
caggcaagaaggaccugua

SEQ ID NO: 263 - RNA, 19 nt, Artificial Sequence
  Chemically synthesized
accugugagaccaaauuga

SEQ ID NO: 264 - RNA, 19 nt, Artificial Sequence
  Chemically synthesized
cuuuguugcuaucaaucca

SEQ ID NO: 265 - RNA, 19 nt, Artificial Sequence
  Chemically synthesized
gugagaccaaauugagcua

SEQ ID NO: 266 - RNA, 19 nt, Artificial Sequence
  Chemically synthesized
cccugaaagucccagauca

SEQ ID NO: 267 - RNA, 19 nt, Artificial Sequence
  Chemically synthesized
ccuuugaccaggacaucua

SEQ ID NO: 268 - RNA, 19 nt, Artificial Sequence
  Chemically synthesized
gaccaggcaguggagaaca

SEQ ID NO: 269 - RNA, 19 nt, Artificial Sequence
  Chemically synthesized
cgcgcaacgugaccuggaa

SEQ ID NO: 270 - RNA, 19 nt, Artificial Sequence
  Chemically synthesized
augagaaauuccaccacaa

SEQ ID NO: 271 - RNA, 19 nt, Artificial Sequence
  Chemically synthesized
gaagaaaccugcagccgca

SEQ ID NO: 272 - RNA, 19 nt, Artificial Sequence
  Chemically synthesized
cucucgagcgccuugaaaa

SEQ ID NO: 273 - RNA, 19 nt, Artificial Sequence
  Chemically synthesized
ggaacaugagccuuuguug

SEQ ID NO: 274 - RNA, 19 nt, Artificial Sequence
  Chemically synthesized
cucaccugugagaccaaau

SEQ ID NO: 275 - RNA, 19 nt, Artificial Sequence
  Chemically synthesized
cuacgacgacgagaaggaa

SEQ ID NO: 276 - RNA, 19 nt, Artificial Sequence
  Chemically synthesized
accacaagaugguggacaa

SEQ ID NO: 277 - RNA, 19 nt, Artificial Sequence
  Chemically synthesized
cuggcacugcggagaaguu

SEQ ID NO: 278 - RNA, 19 nt, Artificial Sequence
  Chemically synthesized
gguccuauaccgugggugu

SEQ ID NO: 279 - RNA, 19 nt, Artificial Sequence
  Chemically synthesized
ccaaccucucccaacuaua

SEQ ID NO: 280 - RNA, 19 nt, Artificial Sequence
  Chemically synthesized
gagaaggaaaagcugcaaa

SEQ ID NO: 281 - RNA, 19 nt, Artificial Sequence
  Chemically synthesized
gccucucgagcgccuugaa

SEQ ID NO: 282 - RNA, 19 nt, Artificial Sequence
  Chemically synthesized
aggccauugacaagaacaa

SEQ ID NO: 283 - RNA, 19 nt, Artificial Sequence
  Chemically synthesized
gacccaugaccugcagaaa

SEQ ID NO: 284 - RNA, 19 nt, Artificial Sequence
  Chemically synthesized
cuccuggcacugcggagaa

SEQ ID NO: 285 - RNA, 19 nt, Artificial Sequence
  Chemically synthesized
cggacaggccucuacaacu

SEQ ID NO: 286 - RNA, 19 nt, Artificial Sequence
  Chemically synthesized
gaugagaaauuccaccaca

SEQ ID NO: 287 - RNA, 19 nt, Artificial Sequence
  Chemically synthesized
cacgcaugucaggcaagaa

SEQ ID NO: 288 - RNA, 19 nt, Artificial Sequence
  Chemically synthesized
accucucccaacuauaaaa

SEQ ID NO: 289 - RNA, 19 nt, Artificial Sequence
  Chemically synthesized
accaggcaguggagaacau

SEQ ID NO: 290 - RNA, 19 nt, Artificial Sequence
  Chemically synthesized
gggaacaugagccuuuguu

SEQ ID NO: 291 - RNA, 19 nt, Artificial Sequence
  Chemically synthesized
agaauucacuccacuugga

SEQ ID NO: 292 - RNA, 19 nt, Artificial Sequence
  Chemically synthesized
gggcagacucuggucaaga

SEQ ID NO: 293 - RNA, 19 nt, Artificial Sequence
  Chemically synthesized
agaaggaaaagcugcaaau

SEQ ID NO: 294 - RNA, 19 nt, Artificial Sequence
  Chemically synthesized
ggcaguggagaacauccug

SEQ ID NO: 295 - RNA, 19 nt, Artificial Sequence
  Chemically synthesized
gggaugagaaauuccacca

SEQ ID NO: 296 - RNA, 19 nt, Artificial Sequence
  Chemically synthesized
ccaagcuguucuacgccga

SEQ ID NO: 297 - RNA, 19 nt, Artificial Sequence
  Chemically synthesized
accggacaggccucuacaa

SEQ ID NO: 298 - RNA, 19 nt, Artificial Sequence
  Chemically synthesized
cugccucaaucaguauuca

SEQ ID NO: 299 - RNA, 19 nt, Artificial Sequence
  Chemically synthesized
cagcccucuucugacacua

SEQ ID NO: 300 - RNA, 19 nt, Artificial Sequence
  Chemically synthesized
ccagccucaucauccucau

SEQ ID NO: 301 - RNA, 19 nt, Artificial Sequence
  Chemically synthesized
agggugacaagaugcgaga

SEQ ID NO: 302 - RNA, 19 nt, Artificial Sequence
  Chemically synthesized
ggaccaggcaguggagaac

SEQ ID NO: 303 - RNA, 19 nt, Artificial Sequence
  Chemically synthesized
gcagcgcgcugcaguccau

SEQ ID NO: 304 - RNA, 19 nt, Artificial Sequence
  Chemically synthesized
gcgcgcugcaguccaucaa

SEQ ID NO: 305 - RNA, 19 nt, Artificial Sequence
  Chemically synthesized
ccagauaccaugaugcuga

SEQ ID NO: 306 - RNA, 19 nt, Artificial Sequence
  Chemically synthesized
cuagugcgggacacccaaa

SEQ ID NO: 307 - RNA, 19 nt, Artificial Sequence
  Chemically synthesized
aggcaguggagaacauccu

SEQ ID NO: 308 - RNA, 19 nt, Artificial Sequence
  Chemically synthesized
cugagacacaugggugcua

SEQ ID NO: 309 - RNA, 19 nt, Artificial Sequence
  Chemically synthesized
gauugagaaggagcuccca

SEQ ID NO: 310 - RNA, 19 nt, Artificial Sequence
  Chemically synthesized
cgcagaccaccgacggcaa

SEQ ID NO: 311 - RNA, 19 nt, Artificial Sequence
  Chemically synthesized
ccacacugggaugagaaau

SEQ ID NO: 312 - RNA, 19 nt, Artificial Sequence
  Chemically synthesized
gcucagugagcuucgcuga

SEQ ID NO: 313 - RNA, 19 nt, Artificial Sequence
  Chemically synthesized
cgccuuugaguuggacaca

SEQ ID NO: 314 - RNA, 19 nt, Artificial Sequence
  Chemically synthesized
gggucagccagcccucuuc

SEQ ID NO: 315 - RNA, 19 nt, Artificial Sequence
  Chemically synthesized
gggcuucugggcagacucu

SEQ ID NO: 316 - RNA, 19 nt, Artificial Sequence
  Chemically synthesized
gguaccuucucaccuguga

SEQ ID NO: 317 - RNA, 19 nt, Artificial Sequence
  Chemically synthesized
gccugccucaaucaguauu

SEQ ID NO: 318 - RNA, 19 nt, Artificial Sequence
  Chemically synthesized
ucuacaacuacuacgacga

SEQ ID NO: 319 - RNA, 19 nt, Artificial Sequence
  Chemically synthesized
gggaagaugcagaagaagg

SEQ ID NO: 320 - RNA, 19 nt, Artificial Sequence
  Chemically synthesized
cgagaaggaaaagcugcaa

SEQ ID NO: 321 - RNA, 19 nt, Artificial Sequence
  Chemically synthesized
agaagaaggcuguugccau

SEQ ID NO: 322 - RNA, 19 nt, Artificial Sequence
  Chemically synthesized
cacaagcucuccagccuca

SEQ ID NO: 323 - RNA, 19 nt, Artificial Sequence
  Chemically synthesized
gggugacaagaugcgagac

SEQ ID NO: 324 - RNA, 19 nt, Artificial Sequence
  Chemically synthesized
uguuggagcguggaaaaaa

SEQ ID NO: 325 - RNA, 19 nt, Artificial Sequence
  Chemically synthesized
cuuugaguuggacacagau

SEQ ID NO: 326 - RNA, 19 nt, Artificial Sequence
  Chemically synthesized
agcucuccagccucaucau

SEQ ID NO: 327 - RNA, 19 nt, Artificial Sequence
  Chemically synthesized
agcuguucuacgccgacca

SEQ ID NO: 328 - RNA, 19 nt, Artificial Sequence
  Chemically synthesized
cugcaguccaucaacgagu

SEQ ID NO: 329 - RNA, 19 nt, Artificial Sequence
  Chemically synthesized
uacgacgacgagaaggaaa

SEQ ID NO: 330 - RNA, 19 nt, Artificial Sequence
  Chemically synthesized
ccuagugcgggacacccaa

SEQ ID NO: 331 - RNA, 19 nt, Artificial Sequence
  Chemically synthesized
cuucucaccugugagacca

SEQ ID NO: 332 - RNA, 19 nt, Artificial Sequence
  Chemically synthesized
aguuggacacagauggcaa

SEQ ID NO: 333 - RNA, 19 nt, Artificial Sequence
  Chemically synthesized
caguggagaacauccuggu

SEQ ID NO: 334 - RNA, 19 nt, Artificial Sequence
  Chemically synthesized
ccagcuagaauucacucca

SEQ ID NO: 335 - RNA, 19 nt, Artificial Sequence
  Chemically synthesized
cgcugcaguccaucaacga

SEQ ID NO: 336 - RNA, 19 nt, Artificial Sequence
  Chemically synthesized
ccaaggaccaggcagugga

SEQ ID NO: 337 - RNA, 19 nt, Artificial Sequence
  Chemically synthesized
aguucuucaaagauaggga

SEQ ID NO: 338 - RNA, 19 nt, Artificial Sequence
  Chemically synthesized
cggaccuucccagcuagaa

SEQ ID NO: 339 - RNA, 19 nt, Artificial Sequence
  Chemically synthesized
gacaagaugcgagacgagu

SEQ ID NO: 340 - RNA, 19 nt, Artificial Sequence
  Chemically synthesized
ccaagaucaacuuccgcga

SEQ ID NO: 341 - RNA, 19 nt, Artificial Sequence
  Chemically synthesized
cccaucacguggagccucu

SEQ ID NO: 342 - RNA, 19 nt, Artificial Sequence
  Chemically synthesized
ccaugaugcugagcccgga

SEQ ID NO: 343 - RNA, 19 nt, Artificial Sequence
  Chemically synthesized
agccugccucaaucaguau

SEQ ID NO: 344 - RNA, 19 nt, Artificial Sequence
  Chemically synthesized
cggccuaagggugacaaga

SEQ ID NO: 345 - RNA, 19 nt, Artificial Sequence
  Chemically synthesized
gggccugacugaggccauu

SEQ ID NO: 346 - RNA, 19 nt, Artificial Sequence
  Chemically synthesized
ucaccugugagaccaaauu

SEQ ID NO: 347 - RNA, 19 nt, Artificial Sequence
  Chemically synthesized
gaggccauugacaagaaca

SEQ ID NO: 348 - RNA, 19 nt, Artificial Sequence
  Chemically synthesized
gcuccuggcacugcggaga

SEQ ID NO: 349 - RNA, 19 nt, Artificial Sequence
  Chemically synthesized
ggcgccugguccggccuaa

SEQ ID NO: 350 - RNA, 19 nt, Artificial Sequence
  Chemically synthesized
ccagcccucuucugacacu

SEQ ID NO: 351 - RNA, 19 nt, Artificial Sequence
  Chemically synthesized
acuacgacgacgagaagga

SEQ ID NO: 352 - RNA, 19 nt, Artificial Sequence
  Chemically synthesized
ccuauaccgugggugucau

SEQ ID NO: 353 - RNA, 19 nt, Artificial Sequence
  Chemically synthesized
gacccagcucagugagcuu

SEQ ID NO: 354 - RNA, 19 nt, Artificial Sequence
  Chemically synthesized
ugggugucaugaugaugca

SEQ ID NO: 355 - RNA, 19 nt, Artificial Sequence
  Chemically synthesized
ccaagggugugguggaggu

SEQ ID NO: 356 - RNA, 19 nt, Artificial Sequence
  Chemically synthesized
aggucaccaaggacgugga

SEQ ID NO: 357 - RNA, 19 nt, Artificial Sequence
  Chemically synthesized
cccuggccgccgaggugaa

SEQ ID NO: 358 - RNA, 19 nt, Artificial Sequence
  Chemically synthesized
agcacuccaagaucaacuu

SEQ ID NO: 359 - RNA, 19 nt, Artificial Sequence
  Chemically synthesized
ccuggcacugcggagaagu

SEQ ID NO: 360 - RNA, 19 nt, Artificial Sequence
  Chemically synthesized
gaugcagaagaaggcuguu

SEQ ID NO: 361 - RNA, 19 nt, Artificial Sequence
  Chemically synthesized
cccacaagcucuccagccu

SEQ ID NO: 362 - RNA, 19 nt, Artificial Sequence
  Chemically synthesized
cucuucugacacuaaaaca

SEQ ID NO: 363 - RNA, 19 nt, Artificial Sequence
  Chemically synthesized
acgagaaggaaaagcugca

SEQ ID NO: 364 - RNA, 19 nt, Artificial Sequence
  Chemically synthesized
ugaaaagcugcuaaccaaa

SEQ ID NO: 365 - RNA, 19 nt, Artificial Sequence
  Chemically synthesized
ucucaccugugagaccaaa

SEQ ID NO: 366 - RNA, 19 nt, Artificial Sequence
  Chemically synthesized
caugaugaugcaccggaca

SEQ ID NO: 367 - RNA, 19 nt, Artificial Sequence
  Chemically synthesized
ggauugagaaggagcuccc

SEQ ID NO: 368 - RNA, 19 nt, Artificial Sequence
  Chemically synthesized
ccuucaucuuccuagugcg

SEQ ID NO: 369 - RNA, 19 nt, Artificial Sequence
  Chemically synthesized
ggccuggccuucagcuugu

SEQ ID NO: 370 - RNA, 19 nt, Artificial Sequence
  Chemically synthesized
ggucagccagcccucuucu

SEQ ID NO: 371 - RNA, 19 nt, Artificial Sequence
  Chemically synthesized
uucucaccugugagaccaa

SEQ ID NO: 372 - RNA, 19 nt, Artificial Sequence
  Chemically synthesized
cgcagcagcuccuggcacu

SEQ ID NO: 373 - RNA, 19 nt, Artificial Sequence
  Chemically synthesized
gccauguucuucaagccac

SEQ ID NO: 374 - RNA, 19 nt, Artificial Sequence
  Chemically synthesized
aggcagugcugagcgccga

SEQ ID NO: 375 - RNA, 19 nt, Artificial Sequence
  Chemically synthesized
caccugugagaccaaauug

SEQ ID NO: 376 - RNA, 19 nt, Artificial Sequence
  Chemically synthesized
caccggacaggccucuaca

SEQ ID NO: 377 - RNA, 19 nt, Artificial Sequence
  Chemically synthesized
agcuagaauucacuccacu

SEQ ID NO: 378 - RNA, 19 nt, Artificial Sequence
  Chemically synthesized
agaugcagaagaaggcugu

SEQ ID NO: 379 - RNA, 19 nt, Artificial Sequence
  Chemically synthesized
cccugcuagucaacgccau

SEQ ID NO: 380 - RNA, 19 nt, Artificial Sequence
  Chemically synthesized
acaacuacuacgacgacga

SEQ ID NO: 381 - RNA, 19 nt, Artificial Sequence
  Chemically synthesized
gcuccugagacacaugggu

SEQ ID NO: 382 - RNA, 19 nt, Artificial Sequence
  Chemically synthesized
uggagaacauccugguguc

SEQ ID NO: 383 - RNA, 19 nt, Artificial Sequence
  Chemically synthesized
agcgcgcugcaguccauca

SEQ ID NO: 384 - RNA, 19 nt, Artificial Sequence
  Chemically synthesized
cgccuugaaaagcugcuaa

SEQ ID NO: 385 - RNA, 19 nt, Artificial Sequence
  Chemically synthesized
gccuuuguugcuaucaauc

SEQ ID NO: 386 - RNA, 19 nt, Artificial Sequence
  Chemically synthesized
cucuacaacuacuacgacg

SEQ ID NO: 387 - RNA, 19 nt, Artificial Sequence
  Chemically synthesized
cgcucacucagcaacucca

SEQ ID NO: 388 - RNA, 19 nt, Artificial Sequence
  Chemically synthesized
gguaccagccuuggauacu

SEQ ID NO: 389 - RNA, 19 nt, Artificial Sequence
  Chemically synthesized
gccugacugaggccauuga

SEQ ID NO: 390 - RNA, 19 nt, Artificial Sequence
  Chemically synthesized
ugagcuucgcugaugacuu

SEQ ID NO: 391 - RNA, 19 nt, Artificial Sequence
  Chemically synthesized
ccagccuuggauacuccau

SEQ ID NO: 392 - RNA, 19 nt, Artificial Sequence
  Chemically synthesized
aaaggcuccugagacacau

SEQ ID NO: 393 - RNA, 19 nt, Artificial Sequence
  Chemically synthesized
ugacccaugaccugcagaa

SEQ ID NO: 394 - RNA, 19 nt, Artificial Sequence
  Chemically synthesized
ccugugagaccaaauugag

SEQ ID NO: 395 - RNA, 19 nt, Artificial Sequence
  Chemically synthesized
gcggaccuucccagcuaga

SEQ ID NO: 396 - RNA, 19 nt, Artificial Sequence
  Chemically synthesized
ggaagaugcagaagaaggc

SEQ ID NO: 397 - RNA, 19 nt, Artificial Sequence
  Chemically synthesized
ugcccaaggguguggugga

SEQ ID NO: 398 - RNA, 19 nt, Artificial Sequence
  Chemically synthesized
ggagccucucgagcgccuu

SEQ ID NO: 399 - RNA, 19 nt, Artificial Sequence
  Chemically synthesized
gacucuggucaagaagcau

SEQ ID NO: 400 - RNA, 19 nt, Artificial Sequence
  Chemically synthesized
caggcaguggagaacaucc

SEQ ID NO: 401 - RNA, 19 nt, Artificial Sequence
  Chemically synthesized
caagccugccucaaucagu

SEQ ID NO: 402 - RNA, 19 nt, Artificial Sequence
  Chemically synthesized
cuggaagcugggcagccga

SEQ ID NO: 403 - RNA, 19 nt, Artificial Sequence
  Chemically synthesized
gaagaaggcuguugccauc

SEQ ID NO: 404 - RNA, 19 nt, Artificial Sequence
  Chemically synthesized
gggcgagcugcugcgcuca

SEQ ID NO: 405 - RNA, 19 nt, Artificial Sequence
  Chemically synthesized
aagccacacugggaugaga

SEQ ID NO: 406 - RNA, 19 nt, Artificial Sequence
  Chemically synthesized
gugugguggaggugaccca

SEQ ID NO: 407 - RNA, 19 nt, Artificial Sequence
  Chemically synthesized
ccgccuuugaguuggacac

SEQ ID NO: 408 - RNA, 19 nt, Artificial Sequence
  Chemically synthesized
ggccauugacaagaacaag

SEQ ID NO: 409 - RNA, 19 nt, Artificial Sequence
  Chemically synthesized
ugccucaaucaguauucau

SEQ ID NO: 410 - RNA, 19 nt, Artificial Sequence
  Chemically synthesized
ccuucccagcuagaauuca

SEQ ID NO: 411 - RNA, 19 nt, Artificial Sequence
  Chemically synthesized
gggaccugggccauaguca

SEQ ID NO: 412 - RNA, 19 nt, Artificial Sequence
  Chemically synthesized
cgaggugaagaaaccugca

SEQ ID NO: 413 - RNA, 19 nt, Artificial Sequence
  Chemically synthesized
gccuuugaguuggacacag

SEQ ID NO: 414 - RNA, 19 nt, Artificial Sequence
  Chemically synthesized
agcggaccuucccagcuag

SEQ ID NO: 415 - RNA, 19 nt, Artificial Sequence
  Chemically synthesized
cgcaugucaggcaagaagg

SEQ ID NO: 416 - RNA, 19 nt, Artificial Sequence
  Chemically synthesized
acaacugcgagcacuccaa

SEQ ID NO: 417 - RNA, 19 nt, Artificial Sequence
  Chemically synthesized
gaggcggauugagaaggag

SEQ ID NO: 418 - RNA, 19 nt, Artificial Sequence
  Chemically synthesized
ggccgccgaggugaagaaa

SEQ ID NO: 419 - RNA, 19 nt, Artificial Sequence
  Chemically synthesized
cagcucuaucccaaccucu

SEQ ID NO: 420 - RNA, 19 nt, Artificial Sequence
  Chemically synthesized
agcugggcagccgacugua

SEQ ID NO: 421 - RNA, 19 nt, Artificial Sequence
  Chemically synthesized
gccauugacaagaacaagg

SEQ ID NO: 422 - RNA, 19 nt, Artificial Sequence
  Chemically synthesized
cgccauguucuucaagcca

SEQ ID NO: 423 - RNA, 19 nt, Artificial Sequence
  Chemically synthesized
ccgaggucaccaaggacgu

SEQ ID NO: 424 - RNA, 19 nt, Artificial Sequence
  Chemically synthesized
ggacccagcucagugagcu

SEQ ID NO: 425 - RNA, 19 nt, Artificial Sequence
  Chemically synthesized
ccaaugacauuuuguugga

SEQ ID NO: 426 - RNA, 19 nt, Artificial Sequence
  Chemically synthesized
agugaggcggauugagaag

SEQ ID NO: 427 - RNA, 19 nt, Artificial Sequence
  Chemically synthesized
ugcaguccaucaacgagug

SEQ ID NO: 428 - RNA, 19 nt, Artificial Sequence
  Chemically synthesized
ugucacgcaugucaggcaa

SEQ ID NO: 429 - RNA, 19 nt, Artificial Sequence
  Chemically synthesized
cgacgacgagaaggaaaag

SEQ ID NO: 430 - RNA, 19 nt, Artificial Sequence
  Chemically synthesized
acaagaacaaggccgacuu

SEQ ID NO: 431 - RNA, 19 nt, Artificial Sequence
  Chemically synthesized
cuucaagccacacugggau

SEQ ID NO: 432 - RNA, 19 nt, Artificial Sequence
  Chemically synthesized
ccugggccauagucauucu

SEQ ID NO: 433 - RNA, 19 nt, Artificial Sequence
  Chemically synthesized
uuuguuggagcguggaaaa

SEQ ID NO: 434 - RNA, 19 nt, Artificial Sequence
  Chemically synthesized
agaacauccuggugucacc

SEQ ID NO: 435 - RNA, 19 nt, Artificial Sequence
  Chemically synthesized
acgccaccgccuuugaguu

SEQ ID NO: 436 - RNA, 19 nt, Artificial Sequence
  Chemically synthesized
gugagguaccagccuugga

SEQ ID NO: 437 - RNA, 19 nt, Artificial Sequence
  Chemically synthesized
gcgccuucugccuccugga

SEQ ID NO: 438 - RNA, 19 nt, Artificial Sequence
  Chemically synthesized
gccuggccuucagcuugua

SEQ ID NO: 439 - RNA, 19 nt, Artificial Sequence
  Chemically synthesized
cccggaaacuccacauccu

SEQ ID NO: 440 - RNA, 19 nt, Artificial Sequence
  Chemically synthesized
ucuucaagccacacuggga

SEQ ID NO: 441 - RNA, 19 nt, Artificial Sequence
  Chemically synthesized
uguugcuaucaauccaaga

SEQ ID NO: 442 - RNA, 19 nt, Artificial Sequence
  Chemically synthesized
gagugggccgcgcagacca

SEQ ID NO: 443 - RNA, 19 nt, Artificial Sequence
  Chemically synthesized
ccugagacacaugggugcu

SEQ ID NO: 444 - RNA, 19 nt, Artificial Sequence
  Chemically synthesized
agccgacuguacggaccca

SEQ ID NO: 445 - RNA, 19 nt, Artificial Sequence
  Chemically synthesized
gggccucagggugcacaca

SEQ ID NO: 446 - RNA, 19 nt, Artificial Sequence
  Chemically synthesized
acugggaugagaaauucca

SEQ ID NO: 447 - RNA, 19 nt, Artificial Sequence
  Chemically synthesized
agaaugaccuggccgcagu

SEQ ID NO: 448 - RNA, 19 nt, Artificial Sequence
  Chemically synthesized
cauauuuauagccagguac

SEQ ID NO: 449 - RNA, 19 nt, Artificial Sequence
  Chemically synthesized
aggugacccaugaccugca

SEQ ID NO: 450 - RNA, 19 nt, Artificial Sequence
  Chemically synthesized
gcgcugcaguccaucaacg

SEQ ID NO: 451 - RNA, 19 nt, Artificial Sequence
  Chemically synthesized
ggugacaagaugcgagacg

SEQ ID NO: 452 - RNA, 19 nt, Artificial Sequence
  Chemically synthesized
cuucaaagauagggaggga

SEQ ID NO: 453 - RNA, 19 nt, Artificial Sequence
  Chemically synthesized
agcugcaaaucguggagau

SEQ ID NO: 454 - RNA, 19 nt, Artificial Sequence
  Chemically synthesized
guggagaacauccuggugu

SEQ ID NO: 455 - RNA, 19 nt, Artificial Sequence
  Chemically synthesized
gaacaaggccgacuuguca

SEQ ID NO: 456 - RNA, 19 nt, Artificial Sequence
  Chemically synthesized
caugaugcugagcccggaa

SEQ ID NO: 457 - RNA, 19 nt, Artificial Sequence
  Chemically synthesized
gcgccuugaaaagcugcua

SEQ ID NO: 458 - RNA, 19 nt, Artificial Sequence
  Chemically synthesized
gcagacucuggucaagaag

SEQ ID NO: 459 - RNA, 19 nt, Artificial Sequence
  Chemically synthesized
ccaggcaguggagaacauc

SEQ ID NO: 460 - RNA, 19 nt, Artificial Sequence
  Chemically synthesized
uucuugaccagagucugcc

SEQ ID NO: 461 - RNA, 19 nt, Artificial Sequence
  Chemically synthesized
uucucaauccgccucacug

SEQ ID NO: 462 - RNA, 19 nt, Artificial Sequence
  Chemically synthesized
auugauagcaacaaaggcu

SEQ ID NO: 463 - RNA, 19 nt, Artificial Sequence
  Chemically synthesized
uguggcuugaagaacaugg

SEQ ID NO: 464 - RNA, 19 nt, Artificial Sequence
  Chemically synthesized
uuuuagugucagaagaggg

SEQ ID NO: 465 - RNA, 19 nt, Artificial Sequence
  Chemically synthesized
auaugaauacugauugagg

SEQ ID NO: 466 - RNA, 19 nt, Artificial Sequence
  Chemically synthesized
aauagcacccaugugucuc

SEQ ID NO: 467 - RNA, 19 nt, Artificial Sequence
  Chemically synthesized
ucgucucgcaucuugucac

SEQ ID NO: 468 - RNA, 19 nt, Artificial Sequence
  Chemically synthesized
uuucucaucccaguguggc

SEQ ID NO: 469 - RNA, 19 nt, Artificial Sequence
  Chemically synthesized
uauaacucgucucgcaucu

SEQ ID NO: 470 - RNA, 19 nt, Artificial Sequence
  Chemically synthesized
uuuuccuucucgucgucgu

SEQ ID NO: 471 - RNA, 19 nt, Artificial Sequence
  Chemically synthesized
ucguaguaguuguagaggc

SEQ ID NO: 472 - RNA, 19 nt, Artificial Sequence
  Chemically synthesized
uugucgcggaaguugaucu

SEQ ID NO: 473 - RNA, 19 nt, Artificial Sequence
  Chemically synthesized
uucucgucgucguaguagu

SEQ ID NO: 474 - RNA, 19 nt, Artificial Sequence
  Chemically synthesized
uuagugucagaagagggcu

SEQ ID NO: 475 - RNA, 19 nt, Artificial Sequence
  Chemically synthesized
aacucgucucgcaucuugu

SEQ ID NO: 476 - RNA, 19 nt, Artificial Sequence
  Chemically synthesized
uucucaucccaguguggcu

SEQ ID NO: 477 - RNA, 19 nt, Artificial Sequence
  Chemically synthesized
uucuccacugccugguccu

SEQ ID NO: 478 - RNA, 19 nt, Artificial Sequence
  Chemically synthesized
uacagguccuucuugccug

SEQ ID NO: 479 - RNA, 19 nt, Artificial Sequence
  Chemically synthesized
ucaauuuggucucacaggu

SEQ ID NO: 480 - RNA, 19 nt, Artificial Sequence
  Chemically synthesized
uggauugauagcaacaaag

SEQ ID NO: 481 - RNA, 19 nt, Artificial Sequence
  Chemically synthesized
uagcucaauuuggucucac

SEQ ID NO: 482 - RNA, 19 nt, Artificial Sequence
  Chemically synthesized
ugaucugggacuuucaggg

SEQ ID NO: 483 - RNA, 19 nt, Artificial Sequence
  Chemically synthesized
uagauguccuggucaaagg

SEQ ID NO: 484 - RNA, 19 nt, Artificial Sequence
  Chemically synthesized
uguucuccacugccugguc

SEQ ID NO: 485 - RNA, 19 nt, Artificial Sequence
  Chemically synthesized
uuccaggucacguugcgcg

SEQ ID NO: 486 - RNA, 19 nt, Artificial Sequence
  Chemically synthesized
uugugguggaauuucucau

SEQ ID NO: 487 - RNA, 19 nt, Artificial Sequence
  Chemically synthesized
ugcggcugcagguuucuuc

SEQ ID NO: 488 - RNA, 19 nt, Artificial Sequence
  Chemically synthesized
uuuucaaggcgcucgagag

SEQ ID NO: 489 - RNA, 19 nt, Artificial Sequence
  Chemically synthesized
caacaaaggcucauguucc

SEQ ID NO: 490 - RNA, 19 nt, Artificial Sequence
  Chemically synthesized
auuuggucucacaggugag

SEQ ID NO: 491 - RNA, 19 nt, Artificial Sequence
  Chemically synthesized
uuccuucucgucgucguag

SEQ ID NO: 492 - RNA, 19 nt, Artificial Sequence
  Chemically synthesized
uuguccaccaucuuguggu

SEQ ID NO: 493 - RNA, 19 nt, Artificial Sequence
  Chemically synthesized
aacuucuccgcagugccag

SEQ ID NO: 494 - RNA, 19 nt, Artificial Sequence
  Chemically synthesized
acacccacgguauaggacc

SEQ ID NO: 495 - RNA, 19 nt, Artificial Sequence
  Chemically synthesized
uauaguugggagagguugg

SEQ ID NO: 496 - RNA, 19 nt, Artificial Sequence
  Chemically synthesized
uuugcagcuuuuccuucuc

SEQ ID NO: 497 - RNA, 19 nt, Artificial Sequence
  Chemically synthesized
uucaaggcgcucgagaggc

SEQ ID NO: 498 - RNA, 19 nt, Artificial Sequence
  Chemically synthesized
uuguucuugucaauggccu

SEQ ID NO: 499 - RNA, 19 nt, Artificial Sequence
  Chemically synthesized
uuucugcaggucauggguc

SEQ ID NO: 500 - RNA, 19 nt, Artificial Sequence
  Chemically synthesized
uucuccgcagugccaggag

SEQ ID NO: 501 - RNA, 19 nt, Artificial Sequence
  Chemically synthesized
aguuguagaggccuguccg

SEQ ID NO: 502 - RNA, 19 nt, Artificial Sequence
  Chemically synthesized
ugugguggaauuucucauc

SEQ ID NO: 503 - RNA, 19 nt, Artificial Sequence
  Chemically synthesized
uucuugccugacaugcgug

SEQ ID NO: 504 - RNA, 19 nt, Artificial Sequence
  Chemically synthesized
uuuuauaguugggagaggu

SEQ ID NO: 505 - RNA, 19 nt, Artificial Sequence
  Chemically synthesized
auguucuccacugccuggu

SEQ ID NO: 506 - RNA, 19 nt, Artificial Sequence
  Chemically synthesized
aacaaaggcucauguuccc

SEQ ID NO: 507 - RNA, 19 nt, Artificial Sequence
  Chemically synthesized
uccaaguggagugaauucu

SEQ ID NO: 508 - RNA, 19 nt, Artificial Sequence
  Chemically synthesized
ucuugaccagagucugccc

SEQ ID NO: 509 - RNA, 19 nt, Artificial Sequence
  Chemically synthesized
auuugcagcuuuuccuucu

SEQ ID NO: 510 - RNA, 19 nt, Artificial Sequence
  Chemically synthesized
caggauguucuccacugcc

SEQ ID NO: 511 - RNA, 19 nt, Artificial Sequence
  Chemically synthesized
ugguggaauuucucauccc

SEQ ID NO: 512 - RNA, 19 nt, Artificial Sequence
  Chemically synthesized
ucggcguagaacagcuugg

SEQ ID NO: 513 - RNA, 19 nt, Artificial Sequence
  Chemically synthesized
uuguagaggccuguccggu

SEQ ID NO: 514 - RNA, 19 nt, Artificial Sequence
  Chemically synthesized
ugaauacugauugaggcag

SEQ ID NO: 515 - RNA, 19 nt, Artificial Sequence
  Chemically synthesized
uagugucagaagagggcug

SEQ ID NO: 516 - RNA, 19 nt, Artificial Sequence
  Chemically synthesized
augaggaugaugaggcugg

SEQ ID NO: 517 - RNA, 19 nt, Artificial Sequence
  Chemically synthesized
ucucgcaucuugucacccu

SEQ ID NO: 518 - RNA, 19 nt, Artificial Sequence
  Chemically synthesized
guucuccacugccuggucc

SEQ ID NO: 519 - RNA, 19 nt, Artificial Sequence
  Chemically synthesized
auggacugcagcgcgcugc

SEQ ID NO: 520 - RNA, 19 nt, Artificial Sequence
  Chemically synthesized
uugauggacugcagcgcgc

SEQ ID NO: 521 - RNA, 19 nt, Artificial Sequence
  Chemically synthesized
ucagcaucaugguaucugg

SEQ ID NO: 522 - RNA, 19 nt, Artificial Sequence
  Chemically synthesized
uuugggugucccgcacuag

SEQ ID NO: 523 - RNA, 19 nt, Artificial Sequence
  Chemically synthesized
aggauguucuccacugccu

SEQ ID NO: 524 - RNA, 19 nt, Artificial Sequence
  Chemically synthesized
uagcacccaugugucucag

SEQ ID NO: 525 - RNA, 19 nt, Artificial Sequence
  Chemically synthesized
ugggagcuccuucucaauc

SEQ ID NO: 526 - RNA, 19 nt, Artificial Sequence
  Chemically synthesized
uugccgucgguggucugcg

SEQ ID NO: 527 - RNA, 19 nt, Artificial Sequence
  Chemically synthesized
auuucucaucccagugugg

SEQ ID NO: 528 - RNA, 19 nt, Artificial Sequence
  Chemically synthesized
ucagcgaagcucacugagc

SEQ ID NO: 529 - RNA, 19 nt, Artificial Sequence
  Chemically synthesized
uguguccaacucaaaggcg

SEQ ID NO: 530 - RNA, 19 nt, Artificial Sequence
  Chemically synthesized
gaagagggcuggcugaccc

SEQ ID NO: 531 - RNA, 19 nt, Artificial Sequence
  Chemically synthesized
agagucugcccagaagccc

SEQ ID NO: 532 - RNA, 19 nt, Artificial Sequence
  Chemically synthesized
ucacaggugagaagguacc

SEQ ID NO: 533 - RNA, 19 nt, Artificial Sequence
  Chemically synthesized
aauacugauugaggcaggc

SEQ ID NO: 534 - RNA, 19 nt, Artificial Sequence
  Chemically synthesized
ucgucguaguaguuguaga

SEQ ID NO: 535 - RNA, 19 nt, Artificial Sequence
  Chemically synthesized
ccuucuucugcaucuuccc

SEQ ID NO: 536 - RNA, 19 nt, Artificial Sequence
  Chemically synthesized
uugcagcuuuuccuucucg

SEQ ID NO: 537 - RNA, 19 nt, Artificial Sequence
  Chemically synthesized
auggcaacagccuucuucu

SEQ ID NO: 538 - RNA, 19 nt, Artificial Sequence
  Chemically synthesized
ugaggcuggagagcuugug

SEQ ID NO: 539 - RNA, 19 nt, Artificial Sequence
  Chemically synthesized
gucucgcaucuugucaccc

SEQ ID NO: 540 - RNA, 19 nt, Artificial Sequence
  Chemically synthesized
uuuuuuccacgcuccaaca

SEQ ID NO: 541 - RNA, 19 nt, Artificial Sequence
  Chemically synthesized
aucuguguccaacucaaag

SEQ ID NO: 542 - RNA, 19 nt, Artificial Sequence
  Chemically synthesized
augaugaggcuggagagcu

SEQ ID NO: 543 - RNA, 19 nt, Artificial Sequence
  Chemically synthesized
uggucggcguagaacagcu

SEQ ID NO: 544 - RNA, 19 nt, Artificial Sequence
  Chemically synthesized
acucguugauggacugcag

SEQ ID NO: 545 - RNA, 19 nt, Artificial Sequence
  Chemically synthesized
uuuccuucucgucgucgua

SEQ ID NO: 546 - RNA, 19 nt, Artificial Sequence
  Chemically synthesized
uugggugucccgcacuagg

SEQ ID NO: 547 - RNA, 19 nt, Artificial Sequence
  Chemically synthesized
uggucucacaggugagaag

SEQ ID NO: 548 - RNA, 19 nt, Artificial Sequence
  Chemically synthesized
uugccaucuguguccaacu

SEQ ID NO: 549 - RNA, 19 nt, Artificial Sequence
  Chemically synthesized
accaggauguucuccacug

SEQ ID NO: 550 - RNA, 19 nt, Artificial Sequence
  Chemically synthesized
uggagugaauucuagcugg

SEQ ID NO: 551 - RNA, 19 nt, Artificial Sequence
  Chemically synthesized
ucguugauggacugcagcg

SEQ ID NO: 552 - RNA, 19 nt, Artificial Sequence
  Chemically synthesized
uccacugccugguccuugg

SEQ ID NO: 553 - RNA, 19 nt, Artificial Sequence
  Chemically synthesized
ucccuaucuuugaagaacu

SEQ ID NO: 554 - RNA, 19 nt, Artificial Sequence
  Chemically synthesized
uucuagcugggaagguccg

SEQ ID NO: 555 - RNA, 19 nt, Artificial Sequence
  Chemically synthesized
acucgucucgcaucuuguc

SEQ ID NO: 556 - RNA, 19 nt, Artificial Sequence
  Chemically synthesized
ucgcggaaguugaucuugg

SEQ ID NO: 557 - RNA, 19 nt, Artificial Sequence
  Chemically synthesized
agaggcuccacgugauggg

SEQ ID NO: 558 - RNA, 19 nt, Artificial Sequence
  Chemically synthesized
uccgggcucagcaucaugg

SEQ ID NO: 559 - RNA, 19 nt, Artificial Sequence
  Chemically synthesized
auacugauugaggcaggcu

SEQ ID NO: 560 - RNA, 19 nt, Artificial Sequence
  Chemically synthesized
ucuugucacccuuaggccg

SEQ ID NO: 561 - RNA, 19 nt, Artificial Sequence
  Chemically synthesized
aauggccucagucaggccc

SEQ ID NO: 562 - RNA, 19 nt, Artificial Sequence
  Chemically synthesized
aauuuggucucacagguga

SEQ ID NO: 563 - RNA, 19 nt, Artificial Sequence
  Chemically synthesized
uguucuugucaauggccuc

SEQ ID NO: 564 - RNA, 19 nt, Artificial Sequence
  Chemically synthesized
ucuccgcagugccaggagc

SEQ ID NO: 565 - RNA, 19 nt, Artificial Sequence
  Chemically synthesized
uuaggccggaccaggcgcc

SEQ ID NO: 566 - RNA, 19 nt, Artificial Sequence
  Chemically synthesized
agugucagaagagggcugg

SEQ ID NO: 567 - RNA, 19 nt, Artificial Sequence
  Chemically synthesized
uccuucucgucgucguagu

SEQ ID NO: 568 - RNA, 19 nt, Artificial Sequence
  Chemically synthesized
augacacccacgguauagg

SEQ ID NO: 569 - RNA, 19 nt, Artificial Sequence
  Chemically synthesized
aagcucacugagcuggguc

SEQ ID NO: 570 - RNA, 19 nt, Artificial Sequence
  Chemically synthesized
ugcaucaucaugacaccca

SEQ ID NO: 571 - RNA, 19 nt, Artificial Sequence
  Chemically synthesized
accuccaccacacccuugg

SEQ ID NO: 572 - RNA, 19 nt, Artificial Sequence
  Chemically synthesized
uccacguccuuggugaccu

SEQ ID NO: 573 - RNA, 19 nt, Artificial Sequence
  Chemically synthesized
uucaccucggcggccaggg

SEQ ID NO: 574 - RNA, 19 nt, Artificial Sequence
  Chemically synthesized
aaguugaucuuggagugcu

SEQ ID NO: 575 - RNA, 19 nt, Artificial Sequence
  Chemically synthesized
acuucuccgcagugccagg

SEQ ID NO: 576 - RNA, 19 nt, Artificial Sequence
  Chemically synthesized
aacagccuucuucugcauc

SEQ ID NO: 577 - RNA, 19 nt, Artificial Sequence
  Chemically synthesized
aggcuggagagcuuguggg

SEQ ID NO: 578 - RNA, 19 nt, Artificial Sequence
  Chemically synthesized
uguuuuagugucagaagag

SEQ ID NO: 579 - RNA, 19 nt, Artificial Sequence
  Chemically synthesized
ugcagcuuuuccuucucgu

SEQ ID NO: 580 - RNA, 19 nt, Artificial Sequence
  Chemically synthesized
uuugguuagcagcuuuuca

SEQ ID NO: 581 - RNA, 19 nt, Artificial Sequence
  Chemically synthesized
uuuggucucacaggugaga

SEQ ID NO: 582 - RNA, 19 nt, Artificial Sequence
  Chemically synthesized
uguccggugcaucaucaug

SEQ ID NO: 583 - RNA, 19 nt, Artificial Sequence
  Chemically synthesized
gggagcuccuucucaaucc

SEQ ID NO: 584 - RNA, 19 nt, Artificial Sequence
  Chemically synthesized
cgcacuaggaagaugaagg

SEQ ID NO: 585 - RNA, 19 nt, Artificial Sequence
  Chemically synthesized
acaagcugaaggccaggcc

SEQ ID NO: 586 - RNA, 19 nt, Artificial Sequence
  Chemically synthesized
agaagagggcuggcugacc

SEQ ID NO: 587 - RNA, 19 nt, Artificial Sequence
  Chemically synthesized
uuggucucacaggugagaa

SEQ ID NO: 588 - RNA, 19 nt, Artificial Sequence
  Chemically synthesized
agugccaggagcugcugcg

SEQ ID NO: 589 - RNA, 19 nt, Artificial Sequence
  Chemically synthesized
guggcuugaagaacauggc

SEQ ID NO: 590 - RNA, 19 nt, Artificial Sequence
  Chemically synthesized
ucggcgcucagcacugccu

SEQ ID NO: 591 - RNA, 19 nt, Artificial Sequence
  Chemically synthesized
caauuuggucucacaggug

SEQ ID NO: 592 - RNA, 19 nt, Artificial Sequence
  Chemically synthesized
uguagaggccuguccggug

SEQ ID NO: 593 - RNA, 19 nt, Artificial Sequence
  Chemically synthesized
aguggagugaauucuagcu

SEQ ID NO: 594 - RNA, 19 nt, Artificial Sequence
  Chemically synthesized
acagccuucuucugcaucu

SEQ ID NO: 595 - RNA, 19 nt, Artificial Sequence
  Chemically synthesized
auggcguugacuagcaggg

SEQ ID NO: 596 - RNA, 19 nt, Artificial Sequence
  Chemically synthesized
ucgucgucguaguaguugu

SEQ ID NO: 597 - RNA, 19 nt, Artificial Sequence
  Chemically synthesized
acccaugugucucaggagc

SEQ ID NO: 598 - RNA, 19 nt, Artificial Sequence
  Chemically synthesized
gacaccaggauguucucca

SEQ ID NO: 599 - RNA, 19 nt, Artificial Sequence
  Chemically synthesized
ugauggacugcagcgcgcu

SEQ ID NO: 600 - RNA, 19 nt, Artificial Sequence
  Chemically synthesized
uuagcagcuuuucaaggcg

SEQ ID NO: 601 - RNA, 19 nt, Artificial Sequence
  Chemically synthesized
gauugauagcaacaaaggc

SEQ ID NO: 602 - RNA, 19 nt, Artificial Sequence
  Chemically synthesized
cgucguaguaguuguagag

SEQ ID NO: 603 - RNA, 19 nt, Artificial Sequence
  Chemically synthesized
uggaguugcugagugagcg

SEQ ID NO: 604 - RNA, 19 nt, Artificial Sequence
  Chemically synthesized
aguauccaaggcugguacc

SEQ ID NO: 605 - RNA, 19 nt, Artificial Sequence
  Chemically synthesized
ucaauggccucagucaggc

SEQ ID NO: 606 - RNA, 19 nt, Artificial Sequence
  Chemically synthesized
aagucaucagcgaagcuca

SEQ ID NO: 607 - RNA, 19 nt, Artificial Sequence
  Chemically synthesized
auggaguauccaaggcugg

SEQ ID NO: 608 - RNA, 19 nt, Artificial Sequence
  Chemically synthesized
augugucucaggagccuuu

SEQ ID NO: 609 - RNA, 19 nt, Artificial Sequence
  Chemically synthesized
uucugcaggucauggguca

SEQ ID NO: 610 - RNA, 19 nt, Artificial Sequence
  Chemically synthesized
cucaauuuggucucacagg

SEQ ID NO: 611 - RNA, 19 nt, Artificial Sequence
  Chemically synthesized
ucuagcugggaagguccgc

SEQ ID NO: 612 - RNA, 19 nt, Artificial Sequence
  Chemically synthesized
gccuucuucugcaucuucc

SEQ ID NO: 613 - RNA, 19 nt, Artificial Sequence
  Chemically synthesized
uccaccacacccuugggca

SEQ ID NO: 614 - RNA, 19 nt, Artificial Sequence
  Chemically synthesized
aaggcgcucgagaggcucc

SEQ ID NO: 615 - RNA, 19 nt, Artificial Sequence
  Chemically synthesized
augcuucuugaccagaguc

SEQ ID NO: 616 - RNA, 19 nt, Artificial Sequence
  Chemically synthesized
ggauguucuccacugccug

SEQ ID NO: 617 - RNA, 19 nt, Artificial Sequence
  Chemically synthesized
acugauugaggcaggcuug

SEQ ID NO: 618 - RNA, 19 nt, Artificial Sequence
  Chemically synthesized
ucggcugcccagcuuccag

SEQ ID NO: 619 - RNA, 19 nt, Artificial Sequence
  Chemically synthesized
gauggcaacagccuucuuc

SEQ ID NO: 620 - RNA, 19 nt, Artificial Sequence
  Chemically synthesized
ugagcgcagcagcucgccc

SEQ ID NO: 621 - RNA, 19 nt, Artificial Sequence
  Chemically synthesized
ucucaucccaguguggcuu

SEQ ID NO: 622 - RNA, 19 nt, Artificial Sequence
  Chemically synthesized
ugggucaccuccaccacac

SEQ ID NO: 623 - RNA, 19 nt, Artificial Sequence
  Chemically synthesized
guguccaacucaaaggcgg

SEQ ID NO: 624 - RNA, 19 nt, Artificial Sequence
  Chemically synthesized
cuuguucuugucaauggcc

SEQ ID NO: 625 - RNA, 19 nt, Artificial Sequence
  Chemically synthesized
augaauacugauugaggca

SEQ ID NO: 626 - RNA, 19 nt, Artificial Sequence
  Chemically synthesized
ugaauucuagcugggaagg

SEQ ID NO: 627 - RNA, 19 nt, Artificial Sequence
  Chemically synthesized
ugacuauggcccagguccc

SEQ ID NO: 628 - RNA, 19 nt, Artificial Sequence
  Chemically synthesized
ugcagguuucuucaccucg

SEQ ID NO: 629 - RNA, 19 nt, Artificial Sequence
  Chemically synthesized
cuguguccaacucaaaggc

SEQ ID NO: 630 - RNA, 19 nt, Artificial Sequence
  Chemically synthesized
cuagcugggaagguccgcu

SEQ ID NO: 631 - RNA, 19 nt, Artificial Sequence
  Chemically synthesized
ccuucuugccugacaugcg

SEQ ID NO: 632 - RNA, 19 nt, Artificial Sequence
  Chemically synthesized
uuggagugcucgcaguugu

SEQ ID NO: 633 - RNA, 19 nt, Artificial Sequence
  Chemically synthesized
cuccuucucaauccgccuc

SEQ ID NO: 634 - RNA, 19 nt, Artificial Sequence
  Chemically synthesized
uuucuucaccucggcggcc

SEQ ID NO: 635 - RNA, 19 nt, Artificial Sequence
  Chemically synthesized
agagguugggauagagcug

SEQ ID NO: 636 - RNA, 19 nt, Artificial Sequence
  Chemically synthesized
uacagucggcugcccagcu

SEQ ID NO: 637 - RNA, 19 nt, Artificial Sequence
  Chemically synthesized
ccuuguucuugucaauggc

SEQ ID NO: 638 - RNA, 19 nt, Artificial Sequence
  Chemically synthesized
uggcuugaagaacauggcg

SEQ ID NO: 639 - RNA, 19 nt, Artificial Sequence
  Chemically synthesized
acguccuuggugaccucgg

SEQ ID NO: 640 - RNA, 19 nt, Artificial Sequence
  Chemically synthesized
agcucacugagcugggucc

SEQ ID NO: 641 - RNA, 19 nt, Artificial Sequence
  Chemically synthesized
uccaacaaaaugucauugg

SEQ ID NO: 642 - RNA, 19 nt, Artificial Sequence
  Chemically synthesized
cuucucaauccgccucacu

SEQ ID NO: 643 - RNA, 19 nt, Artificial Sequence
  Chemically synthesized
cacucguugauggacugca

SEQ ID NO: 644 - RNA, 19 nt, Artificial Sequence
  Chemically synthesized
uugccugacaugcgugaca

SEQ ID NO: 645 - RNA, 19 nt, Artificial Sequence
  Chemically synthesized
cuuuuccuucucgucgucg

SEQ ID NO: 646 - RNA, 19 nt, Artificial Sequence
  Chemically synthesized
aagucggccuuguucuugu

SEQ ID NO: 647 - RNA, 19 nt, Artificial Sequence
  Chemically synthesized
aucccaguguggcuugaag

SEQ ID NO: 648 - RNA, 19 nt, Artificial Sequence
  Chemically synthesized
agaaugacuauggcccagg

SEQ ID NO: 649 - RNA, 19 nt, Artificial Sequence
  Chemically synthesized
uuuuccacgcuccaacaaa

SEQ ID NO: 650 - RNA, 19 nt, Artificial Sequence
  Chemically synthesized
ggugacaccaggauguucu

SEQ ID NO: 651 - RNA, 19 nt, Artificial Sequence
  Chemically synthesized
aacucaaaggcgguggcgu

SEQ ID NO: 652 - RNA, 19 nt, Artificial Sequence
  Chemically synthesized
uccaaggcugguaccucac

SEQ ID NO: 653 - RNA, 19 nt, Artificial Sequence
  Chemically synthesized
uccaggaggcagaaggcgc

SEQ ID NO: 654 - RNA, 19 nt, Artificial Sequence
  Chemically synthesized
uacaagcugaaggccaggc

SEQ ID NO: 655 - RNA, 19 nt, Artificial Sequence
  Chemically synthesized
aggauguggaguuuccggg

SEQ ID NO: 656 - RNA, 19 nt, Artificial Sequence
  Chemically synthesized
ucccaguguggcuugaaga

SEQ ID NO: 657 - RNA, 19 nt, Artificial Sequence
  Chemically synthesized
ucuuggauugauagcaaca

SEQ ID NO: 658 - RNA, 19 nt, Artificial Sequence
  Chemically synthesized
uggucugcgcggcccacuc

SEQ ID NO: 659 - RNA, 19 nt, Artificial Sequence
  Chemically synthesized
agcacccaugugucucagg

SEQ ID NO: 660 - RNA, 19 nt, Artificial Sequence
  Chemically synthesized
uggguccguacagucggcu

SEQ ID NO: 661 - RNA, 19 nt, Artificial Sequence
  Chemically synthesized
ugugugcacccugaggccc

SEQ ID NO: 662 - RNA, 19 nt, Artificial Sequence
  Chemically synthesized
uggaauuucucaucccagu

SEQ ID NO: 663 - RNA, 19 nt, Artificial Sequence
  Chemically synthesized
acugcggccaggucauucu

SEQ ID NO: 664 - RNA, 19 nt, Artificial Sequence
  Chemically synthesized
guaccuggcuauaaauaug

SEQ ID NO: 665 - RNA, 19 nt, Artificial Sequence
  Chemically synthesized
ugcaggucaugggucaccu

SEQ ID NO: 666 - RNA, 19 nt, Artificial Sequence
  Chemically synthesized
cguugauggacugcagcgc

SEQ ID NO: 667 - RNA, 19 nt, Artificial Sequence
  Chemically synthesized
cgucucgcaucuugucacc

SEQ ID NO: 668 - RNA, 19 nt, Artificial Sequence
  Chemically synthesized
ucccucccuaucuuugaag

SEQ ID NO: 669 - RNA, 19 nt, Artificial Sequence
  Chemically synthesized
aucuccacgauuugcagcu

SEQ ID NO: 670 - RNA, 19 nt, Artificial Sequence
  Chemically synthesized
acaccaggauguucuccac

SEQ ID NO: 671 - RNA, 19 nt, Artificial Sequence
  Chemically synthesized
ugacaagucggccuuguuc

SEQ ID NO: 672 - RNA, 19 nt, Artificial Sequence
  Chemically synthesized
uuccgggcucagcaucaug

SEQ ID NO: 673 - RNA, 19 nt, Artificial Sequence
  Chemically synthesized
uagcagcuuuucaaggcgc

SEQ ID NO: 674 - RNA, 19 nt, Artificial Sequence
  Chemically synthesized
cuucuugaccagagucugc

SEQ ID NO: 675 - RNA, 19 nt, Artificial Sequence
  Chemically synthesized
gauguucuccacugccugg

SEQ ID NO: 676 - RNA, 19 nt, Artificial Sequence
  Chemically synthesized
cacuacaacugcgagcacu

SEQ ID NO: 677 - RNA, 19 nt, Artificial Sequence
  Chemically synthesized
aaccguggcuucaugguga

SEQ ID NO: 678 - RNA, 19 nt, Artificial Sequence
  Chemically synthesized
ggcaagaaggaccuguacc

SEQ ID NO: 679 - RNA, 19 nt, Artificial Sequence
  Chemically synthesized
gguggacaaccguggcuuc

SEQ ID NO: 680 - RNA, 19 nt, Artificial Sequence
  Chemically synthesized
aggccauggccaaggacca

SEQ ID NO: 681 - RNA, 19 nt, Artificial Sequence
  Chemically synthesized
cgcagcgcgcugcagucca

SEQ ID NO: 682 - RNA, 19 nt, Artificial Sequence
  Chemically synthesized
agcagcaagcagcacuaca

SEQ ID NO: 683 - RNA, 19 nt, Artificial Sequence
  Chemically synthesized
ggccucuacaacuacuacg

SEQ ID NO: 684 - RNA, 19 nt, Artificial Sequence
  Chemically synthesized
gaagaugcagaagaaggcu

SEQ ID NO: 685 - RNA, 19 nt, Artificial Sequence
  Chemically synthesized
ggcuccugagacacauggg

SEQ ID NO: 686 - RNA, 19 nt, Artificial Sequence
  Chemically synthesized
agcaagcagcacuacaacu

SEQ ID NO: 687 - RNA, 19 nt, Artificial Sequence
  Chemically synthesized
ggaggugacccaugaccug

SEQ ID NO: 688 - RNA, 19 nt, Artificial Sequence
  Chemically synthesized
cccuuugaccaggacaucu

SEQ ID NO: 689 - RNA, 19 nt, Artificial Sequence
  Chemically synthesized
cuccugagacacaugggug

SEQ ID NO: 690 - RNA, 19 nt, Artificial Sequence
  Chemically synthesized
aaggcuccugagacacaug

SEQ ID NO: 691 - RNA, 19 nt, Artificial Sequence
  Chemically synthesized
cgcgcugcaguccaucaac

SEQ ID NO: 692 - RNA, 19 nt, Artificial Sequence
  Chemically synthesized
agggugugguggaggugac

SEQ ID NO: 693 - RNA, 19 nt, Artificial Sequence
  Chemically synthesized
agcacuacaacugcgagca

SEQ ID NO: 694 - RNA, 19 nt, Artificial Sequence
  Chemically synthesized
ggcucccugcuauucauug

SEQ ID NO: 695 - RNA, 19 nt, Artificial Sequence
  Chemically synthesized
gcgcgcaacgugaccugga

SEQ ID NO: 696 - RNA, 19 nt, Artificial Sequence
  Chemically synthesized
gcugcaguccaucaacgag

SEQ ID NO: 697 - RNA, 19 nt, Artificial Sequence
  Chemically synthesized
accaaagagcagcugaaga

SEQ ID NO: 698 - RNA, 19 nt, Artificial Sequence
  Chemically synthesized
ccaaggacguggagcgcac

SEQ ID NO: 699 - RNA, 19 nt, Artificial Sequence
  Chemically synthesized
uguucuucaagccacacug

SEQ ID NO: 700 - RNA, 19 nt, Artificial Sequence
  Chemically synthesized
gcccaagggugugguggag

SEQ ID NO: 701 - RNA, 19 nt, Artificial Sequence
  Chemically synthesized
acaggccucuacaacuacu

SEQ ID NO: 702 - RNA, 19 nt, Artificial Sequence
  Chemically synthesized
ugcgcagcagcaagcagca

SEQ ID NO: 703 - RNA, 19 nt, Artificial Sequence
  Chemically synthesized
gguggaggugacccaugac

SEQ ID NO: 704 - RNA, 19 nt, Artificial Sequence
  Chemically synthesized
cuuugaccaggacaucuac

SEQ ID NO: 705 - RNA, 19 nt, Artificial Sequence
  Chemically synthesized
aagggugugguggagguga

SEQ ID NO: 706 - RNA, 19 nt, Artificial Sequence
  Chemically synthesized
uccuauaccguggguguca

SEQ ID NO: 707 - RNA, 19 nt, Artificial Sequence
  Chemically synthesized
gcgcagaccaccgacggca

SEQ ID NO: 708 - RNA, 19 nt, Artificial Sequence
  Chemically synthesized
cgcagcagcaagcagcacu

SEQ ID NO: 709 - RNA, 19 nt, Artificial Sequence
  Chemically synthesized
gccucaucauccucaugcc

SEQ ID NO: 710 - RNA, 19 nt, Artificial Sequence
  Chemically synthesized
ucuccagccucaucauccu

SEQ ID NO: 711 - RNA, 19 nt, Artificial Sequence
  Chemically synthesized
ccauugacaagaacaaggc

SEQ ID NO: 712 - RNA, 19 nt, Artificial Sequence
  Chemically synthesized
agcagcacuacaacugcga

SEQ ID NO: 713 - RNA, 19 nt, Artificial Sequence
  Chemically synthesized
ugcaccggacaggccucua

SEQ ID NO: 714 - RNA, 19 nt, Artificial Sequence
  Chemically synthesized
acuccaagaucaacuuccg

SEQ ID NO: 715 - RNA, 19 nt, Artificial Sequence
  Chemically synthesized
uggacaaccguggcuucau

SEQ ID NO: 716 - RNA, 19 nt, Artificial Sequence
  Chemically synthesized
gagcagcugaagaucugga

SEQ ID NO: 717 - RNA, 19 nt, Artificial Sequence
  Chemically synthesized
cagaagaaggcuguugcca

SEQ ID NO: 718 - RNA, 19 nt, Artificial Sequence
  Chemically synthesized
aggcaagaaggaccuguac

SEQ ID NO: 719 - RNA, 19 nt, Artificial Sequence
  Chemically synthesized
ccucuacaacuacuacgac

SEQ ID NO: 720 - RNA, 19 nt, Artificial Sequence
  Chemically synthesized
agcagcugaagaucuggau

SEQ ID NO: 721 - RNA, 19 nt, Artificial Sequence
  Chemically synthesized
aacuacuacgacgacgaga

SEQ ID NO: 722 - RNA, 19 nt, Artificial Sequence
  Chemically synthesized
ggcaagcugcccgagguca

SEQ ID NO: 723 - RNA, 19 nt, Artificial Sequence
  Chemically synthesized
ccggacaggccucuacaac

SEQ ID NO: 724 - RNA, 19 nt, Artificial Sequence
  Chemically synthesized
gcucccugcuauucauugg

SEQ ID NO: 725 - RNA, 19 nt, Artificial Sequence
  Chemically synthesized
aacugcgagcacuccaaga

SEQ ID NO: 726 - RNA, 19 nt, Artificial Sequence
  Chemically synthesized
gacacaugggugcuauugg

SEQ ID NO: 727 - RNA, 19 nt, Artificial Sequence
  Chemically synthesized
gcaccggacaggccucuac

SEQ ID NO: 728 - RNA, 19 nt, Artificial Sequence
  Chemically synthesized
agcgcagcgcgcugcaguc

SEQ ID NO: 729 - RNA, 19 nt, Artificial Sequence
  Chemically synthesized
ggacguggagcgcacggac

SEQ ID NO: 730 - RNA, 19 nt, Artificial Sequence
  Chemically synthesized
cagccucaucauccucaug

SEQ ID NO: 731 - RNA, 19 nt, Artificial Sequence
  Chemically synthesized
aagaucaacuuccgcgaca

SEQ ID NO: 732 - RNA, 19 nt, Artificial Sequence
  Chemically synthesized
gcgcaacgugaccuggaag

SEQ ID NO: 733 - RNA, 19 nt, Artificial Sequence
  Chemically synthesized
acugcgagcacuccaagau

SEQ ID NO: 734 - RNA, 19 nt, Artificial Sequence
  Chemically synthesized
guggacaaccguggcuuca

SEQ ID NO: 735 - RNA, 19 nt, Artificial Sequence
  Chemically synthesized
ccacaagcucuccagccuc

SEQ ID NO: 736 - RNA, 19 nt, Artificial Sequence
  Chemically synthesized
caagaugguggacaaccgu

SEQ ID NO: 737 - RNA, 19 nt, Artificial Sequence
  Chemically synthesized
cgagcacuccaagaucaac

SEQ ID NO: 738 - RNA, 19 nt, Artificial Sequence
  Chemically synthesized
agcugcccgaggucaccaa

SEQ ID NO: 739 - RNA, 19 nt, Artificial Sequence
  Chemically synthesized
ggacaucuacgggcgcgag

SEQ ID NO: 740 - RNA, 19 nt, Artificial Sequence
  Chemically synthesized
aggacaucuacgggcgcga

SEQ ID NO: 741 - RNA, 19 nt, Artificial Sequence
  Chemically synthesized
ugucaggcaagaaggaccu

SEQ ID NO: 742 - RNA, 19 nt, Artificial Sequence
  Chemically synthesized
gggugugguggaggugacc

SEQ ID NO: 743 - RNA, 19 nt, Artificial Sequence
  Chemically synthesized
caagcucuccagccucauc

SEQ ID NO: 744 - RNA, 19 nt, Artificial Sequence
  Chemically synthesized
gugacccaugaccugcaga

SEQ ID NO: 745 - RNA, 19 nt, Artificial Sequence
  Chemically synthesized
guucuucaagccacacugg

SEQ ID NO: 746 - RNA, 19 nt, Artificial Sequence
  Chemically synthesized
acaucuacgggcgcgagga

SEQ ID NO: 747 - RNA, 19 nt, Artificial Sequence
  Chemically synthesized
uggaggugacccaugaccu

SEQ ID NO: 748 - RNA, 19 nt, Artificial Sequence
  Chemically synthesized
ugcagaagaaggcuguugc

SEQ ID NO: 749 - RNA, 19 nt, Artificial Sequence
  Chemically synthesized
uguaccaggccauggccaa

SEQ ID NO: 750 - RNA, 19 nt, Artificial Sequence
  Chemically synthesized
ugugguggaggugacccau

SEQ ID NO: 751 - RNA, 19 nt, Artificial Sequence
  Chemically synthesized
agaaggaccuguaccuggc

SEQ ID NO: 752 - RNA, 19 nt, Artificial Sequence
  Chemically synthesized
agcagcugcgcgacgagga

SEQ ID NO: 753 - RNA, 19 nt, Artificial Sequence
  Chemically synthesized
acgccauguucuucaagcc

SEQ ID NO: 754 - RNA, 19 nt, Artificial Sequence
  Chemically synthesized
acaagaugguggacaaccg

SEQ ID NO: 755 - RNA, 19 nt, Artificial Sequence
  Chemically synthesized
cugcgagcacuccaagauc

SEQ ID NO: 756 - RNA, 19 nt, Artificial Sequence
  Chemically synthesized
gucacgcaugucaggcaag

SEQ ID NO: 757 - RNA, 19 nt, Artificial Sequence
  Chemically synthesized
acgcaugucaggcaagaag

SEQ ID NO: 758 - RNA, 19 nt, Artificial Sequence
  Chemically synthesized
ugcuauucauugggcgccu

SEQ ID NO: 759 - RNA, 19 nt, Artificial Sequence
  Chemically synthesized
ugcgcgacgaggaggugca

SEQ ID NO: 760 - RNA, 19 nt, Artificial Sequence
  Chemically synthesized
gcagcugaagaucuggaug

SEQ ID NO: 761 - RNA, 19 nt, Artificial Sequence
  Chemically synthesized
ccaugaccugcagaaacac

SEQ ID NO: 762 - RNA, 19 nt, Artificial Sequence
  Chemically synthesized
aagcucuccagccucauca

SEQ ID NO: 763 - RNA, 19 nt, Artificial Sequence
  Chemically synthesized
cagcaagcagcacuacaac

SEQ ID NO: 764 - RNA, 19 nt, Artificial Sequence
  Chemically synthesized
auguucuucaagccacacu

SEQ ID NO: 765 - RNA, 19 nt, Artificial Sequence
  Chemically synthesized
uccugagacacaugggugc

SEQ ID NO: 766 - RNA, 19 nt, Artificial Sequence
  Chemically synthesized
cacuccaagaucaacuucc

SEQ ID NO: 767 - RNA, 19 nt, Artificial Sequence
  Chemically synthesized
aagggugacaagaugcgag

SEQ ID NO: 768 - RNA, 19 nt, Artificial Sequence
  Chemically synthesized
gacaggccucuacaacuac

SEQ ID NO: 769 - RNA, 19 nt, Artificial Sequence
  Chemically synthesized
acccaugaccugcagaaac

SEQ ID NO: 770 - RNA, 19 nt, Artificial Sequence
  Chemically synthesized
caccacaagaugguggaca

SEQ ID NO: 771 - RNA, 19 nt, Artificial Sequence
  Chemically synthesized
gcagaagaaggcuguugcc

SEQ ID NO: 772 - RNA, 19 nt, Artificial Sequence
  Chemically synthesized
gugguggaggugacccaug

SEQ ID NO: 773 - RNA, 19 nt, Artificial Sequence
  Chemically synthesized
aggccucuacaacuacuac

SEQ ID NO: 774 - RNA, 19 nt, Artificial Sequence
  Chemically synthesized
ggugacccaugaccugcag

SEQ ID NO: 775 - RNA, 19 nt, Artificial Sequence
  Chemically synthesized
gccgaggugaagaaaccug

SEQ ID NO: 776 - RNA, 19 nt, Artificial Sequence
  Chemically synthesized
caacuacuacgacgacgag

SEQ ID NO: 777 - RNA, 19 nt, Artificial Sequence
  Chemically synthesized
caagaaggaccuguaccug

SEQ ID NO: 778 - RNA, 19 nt, Artificial Sequence
  Chemically synthesized
uguuccacgccaccgccuu

SEQ ID NO: 779 - RNA, 19 nt, Artificial Sequence
  Chemically synthesized
cccugcuauucauugggcg

SEQ ID NO: 780 - RNA, 19 nt, Artificial Sequence
  Chemically synthesized
ccguggcuucauggugacu

SEQ ID NO: 781 - RNA, 19 nt, Artificial Sequence
  Chemically synthesized
cuacaacuacuacgacgac

SEQ ID NO: 782 - RNA, 19 nt, Artificial Sequence
  Chemically synthesized
gcagcacuacaacugcgag

SEQ ID NO: 783 - RNA, 19 nt, Artificial Sequence
  Chemically synthesized
ugguggacaaccguggcuu

SEQ ID NO: 784 - RNA, 19 nt, Artificial Sequence
  Chemically synthesized
agaccaccgacggcaagcu

SEQ ID NO: 785 - RNA, 19 nt, Artificial Sequence
  Chemically synthesized
agaaacaccuggcugggcu

SEQ ID NO: 786 - RNA, 19 nt, Artificial Sequence
  Chemically synthesized
accaaggacguggagcgca

SEQ ID NO: 787 - RNA, 19 nt, Artificial Sequence
  Chemically synthesized
ccgaggugaagaaaccugc

SEQ ID NO: 788 - RNA, 19 nt, Artificial Sequence
  Chemically synthesized
acuacaacugcgagcacuc

SEQ ID NO: 789 - RNA, 19 nt, Artificial Sequence
  Chemically synthesized
acaagcucuccagccucau

SEQ ID NO: 790 - RNA, 19 nt, Artificial Sequence
  Chemically synthesized
aggacguggagcgcacgga

SEQ ID NO: 791 - RNA, 19 nt, Artificial Sequence
  Chemically synthesized
gcuauucauugggcgccug

SEQ ID NO: 792 - RNA, 19 nt, Artificial Sequence
  Chemically synthesized
aacuuccgcgacaagcgca

SEQ ID NO: 793 - RNA, 19 nt, Artificial Sequence
  Chemically synthesized
gcucuccagccucaucauc

SEQ ID NO: 794 - RNA, 19 nt, Artificial Sequence
  Chemically synthesized
agaaggcuguugccaucuc

SEQ ID NO: 795 - RNA, 19 nt, Artificial Sequence
  Chemically synthesized
ggucaccaaggacguggag

SEQ ID NO: 796 - RNA, 19 nt, Artificial Sequence
  Chemically synthesized
agcugcgcgacgaggaggu

SEQ ID NO: 797 - RNA, 19 nt, Artificial Sequence
  Chemically synthesized
cccgaggucaccaaggacg

SEQ ID NO: 798 - RNA, 19 nt, Artificial Sequence
  Chemically synthesized
augucaggcaagaaggacc

SEQ ID NO: 799 - RNA, 19 nt, Artificial Sequence
  Chemically synthesized
cgaggucaccaaggacgug

SEQ ID NO: 800 - RNA, 19 nt, Artificial Sequence
  Chemically synthesized
gaugcaccggacaggccuc

SEQ ID NO: 801 - RNA, 19 nt, Artificial Sequence
  Chemically synthesized
gcacuacaacugcgagcac

SEQ ID NO: 802 - RNA, 19 nt, Artificial Sequence
  Chemically synthesized
ccacaagaugguggacaac

SEQ ID NO: 803 - RNA, 19 nt, Artificial Sequence
  Chemically synthesized
caagggugugguggaggug

SEQ ID NO: 804 - RNA, 19 nt, Artificial Sequence
  Chemically synthesized
agcugaagaucuggauggg

SEQ ID NO: 805 - RNA, 19 nt, Artificial Sequence
  Chemically synthesized
accaggccauggccaagga

SEQ ID NO: 806 - RNA, 19 nt, Artificial Sequence
  Chemically synthesized
cauguucuucaagccacac

SEQ ID NO: 807 - RNA, 19 nt, Artificial Sequence
  Chemically synthesized
caagaucaacuuccgcgac

SEQ ID NO: 808 - RNA, 19 nt, Artificial Sequence
  Chemically synthesized
uccagccucaucauccuca

SEQ ID NO: 809 - RNA, 19 nt, Artificial Sequence
  Chemically synthesized
gcccgaggucaccaaggac

SEQ ID NO: 810 - RNA, 19 nt, Artificial Sequence
  Chemically synthesized
ucaagccacacugggauga

SEQ ID NO: 811 - RNA, 19 nt, Artificial Sequence
  Chemically synthesized
aguccaucaacgagugggc

SEQ ID NO: 812 - RNA, 19 nt, Artificial Sequence
  Chemically synthesized
gacuucgugcgcagcagca

SEQ ID NO: 813 - RNA, 19 nt, Artificial Sequence
  Chemically synthesized
cucuccagccucaucaucc

SEQ ID NO: 814 - RNA, 19 nt, Artificial Sequence
  Chemically synthesized
gcagaccaccgacggcaag

SEQ ID NO: 815 - RNA, 19 nt, Artificial Sequence
  Chemically synthesized
augcagaagaaggcuguug

SEQ ID NO: 816 - RNA, 19 nt, Artificial Sequence
  Chemically synthesized
caaccguggcuucauggug

SEQ ID NO: 817 - RNA, 19 nt, Artificial Sequence
  Chemically synthesized
uacuacgacgacgagaagg

SEQ ID NO: 818 - RNA, 19 nt, Artificial Sequence
  Chemically synthesized
gaaggcuguugccaucucc

SEQ ID NO: 819 - RNA, 19 nt, Artificial Sequence
  Chemically synthesized
ucaccaaggacguggagcg

SEQ ID NO: 820 - RNA, 19 nt, Artificial Sequence
  Chemically synthesized
cagcugaagaucuggaugg

SEQ ID NO: 821 - RNA, 19 nt, Artificial Sequence
  Chemically synthesized
ugggccugacugaggccau

SEQ ID NO: 822 - RNA, 19 nt, Artificial Sequence
  Chemically synthesized
accguggcuucauggugac

SEQ ID NO: 823 - RNA, 19 nt, Artificial Sequence
  Chemically synthesized
caguccaucaacgaguggg

SEQ ID NO: 824 - RNA, 19 nt, Artificial Sequence
  Chemically synthesized
ccgacggcaagcugcccga

SEQ ID NO: 825 - RNA, 19 nt, Artificial Sequence
  Chemically synthesized
acaagcgcagcgcgcugca

SEQ ID NO: 826 - RNA, 19 nt, Artificial Sequence
  Chemically synthesized
gaaacaccuggcugggcug

SEQ ID NO: 827 - RNA, 19 nt, Artificial Sequence
  Chemically synthesized
aggcuccugagacacaugg

SEQ ID NO: 828 - RNA, 19 nt, Artificial Sequence
  Chemically synthesized
caaggacguggagcgcacg

SEQ ID NO: 829 - RNA, 19 nt, Artificial Sequence
  Chemically synthesized
gcaguccaucaacgagugg

SEQ ID NO: 830 - RNA, 19 nt, Artificial Sequence
  Chemically synthesized
agaugguggacaaccgugg

SEQ ID NO: 831 - RNA, 19 nt, Artificial Sequence
  Chemically synthesized
aagcgcagcgcgcugcagu

SEQ ID NO: 832 - RNA, 19 nt, Artificial Sequence
  Chemically synthesized
caugucaggcaagaaggac

SEQ ID NO: 833 - RNA, 19 nt, Artificial Sequence
  Chemically synthesized
caagccacacugggaugag

SEQ ID NO: 834 - RNA, 19 nt, Artificial Sequence
  Chemically synthesized
aagaugcagaagaaggcug

SEQ ID NO: 835 - RNA, 19 nt, Artificial Sequence
  Chemically synthesized
ggccauggccaaggaccag

SEQ ID NO: 836 - RNA, 19 nt, Artificial Sequence
  Chemically synthesized
gugcgcagcagcaagcagc

SEQ ID NO: 837 - RNA, 19 nt, Artificial Sequence
  Chemically synthesized
caacugcgagcacuccaag

SEQ ID NO: 838 - RNA, 19 nt, Artificial Sequence
  Chemically synthesized
uacaacugcgagcacucca

SEQ ID NO: 839 - RNA, 19 nt, Artificial Sequence
  Chemically synthesized
cauugacaagaacaaggcc

SEQ ID NO: 840 - RNA, 19 nt, Artificial Sequence
  Chemically synthesized
caagcagcacuacaacugc

SEQ ID NO: 841 - RNA, 19 nt, Artificial Sequence
  Chemically synthesized
guguuccacgccaccgccu

SEQ ID NO: 842 - RNA, 19 nt, Artificial Sequence
  Chemically synthesized
ccugcuauucauugggcgc

SEQ ID NO: 843 - RNA, 19 nt, Artificial Sequence
  Chemically synthesized
gcccacaagcucuccagcc

SEQ ID NO: 844 - RNA, 19 nt, Artificial Sequence
  Chemically synthesized
cagcagcaagcagcacuac

SEQ ID NO: 845 - RNA, 19 nt, Artificial Sequence
  Chemically synthesized
ugaugcaccggacaggccu

SEQ ID NO: 846 - RNA, 19 nt, Artificial Sequence
  Chemically synthesized
ucaacuuccgcgacaagcg

SEQ ID NO: 847 - RNA, 19 nt, Artificial Sequence
  Chemically synthesized
ucaggcaagaaggaccugu

SEQ ID NO: 848 - RNA, 19 nt, Artificial Sequence
  Chemically synthesized
acuucgugcgcagcagcaa

SEQ ID NO: 849 - RNA, 19 nt, Artificial Sequence
  Chemically synthesized
acaaccguggcuucauggu

SEQ ID NO: 850 - RNA, 19 nt, Artificial Sequence
  Chemically synthesized
aaggcuguugccaucuccu

SEQ ID NO: 851 - RNA, 19 nt, Artificial Sequence
  Chemically synthesized
gcagcugcgcgacgaggag

SEQ ID NO: 852 - RNA, 19 nt, Artificial Sequence
  Chemically synthesized
uauucauugggcgccuggu

SEQ ID NO: 853 - RNA, 19 nt, Artificial Sequence
  Chemically synthesized
uccaccacaagauggugga

SEQ ID NO: 854 - RNA, 19 nt, Artificial Sequence
  Chemically synthesized
cccuggcccacaagcucuc

SEQ ID NO: 855 - RNA, 19 nt, Artificial Sequence
  Chemically synthesized
accaggacaucuacgggcg

SEQ ID NO: 856 - RNA, 19 nt, Artificial Sequence
  Chemically synthesized
gaugaugcaccggacaggc

SEQ ID NO: 857 - RNA, 19 nt, Artificial Sequence
  Chemically synthesized
caacgccauguucuucaag

SEQ ID NO: 858 - RNA, 19 nt, Artificial Sequence
  Chemically synthesized
acggcaagcugcccgaggu

SEQ ID NO: 859 - RNA, 19 nt, Artificial Sequence
  Chemically synthesized
cagcgcgcugcaguccauc

SEQ ID NO: 860 - RNA, 19 nt, Artificial Sequence
  Chemically synthesized
cccaagggugugguggagg

SEQ ID NO: 861 - RNA, 19 nt, Artificial Sequence
  Chemically synthesized
cauggccaaggaccaggca

SEQ ID NO: 862 - RNA, 19 nt, Artificial Sequence
  Chemically synthesized
cuccagccucaucauccuc

SEQ ID NO: 863 - RNA, 19 nt, Artificial Sequence
  Chemically synthesized
ucuacgggcgcgaggagcu

SEQ ID NO: 864 - RNA, 19 nt, Artificial Sequence
  Chemically synthesized
ggcccacaagcucuccagc

SEQ ID NO: 865 - RNA, 19 nt, Artificial Sequence
  Chemically synthesized
gucaggcaagaaggaccug

SEQ ID NO: 866 - RNA, 19 nt, Artificial Sequence
  Chemically synthesized
caucuacgggcgcgaggag

SEQ ID NO: 867 - RNA, 19 nt, Artificial Sequence
  Chemically synthesized
cgugcgcagcagcaagcag

SEQ ID NO: 868 - RNA, 19 nt, Artificial Sequence
  Chemically synthesized
agccucaucauccucaugc

SEQ ID NO: 869 - RNA, 19 nt, Artificial Sequence
  Chemically synthesized
uucaagccacacugggaug

SEQ ID NO: 870 - RNA, 19 nt, Artificial Sequence
  Chemically synthesized
aagaaggcuguugccaucu

SEQ ID NO: 871 - RNA, 19 nt, Artificial Sequence
  Chemically synthesized
ggugugguggaggugaccc

SEQ ID NO: 872 - RNA, 19 nt, Artificial Sequence
  Chemically synthesized
gaggugacccaugaccugc

SEQ ID NO: 873 - RNA, 19 nt, Artificial Sequence
  Chemically synthesized
guggaggugacccaugacc

SEQ ID NO: 874 - RNA, 19 nt, Artificial Sequence
  Chemically synthesized
cacaagaugguggacaacc

SEQ ID NO: 875 - RNA, 19 nt, Artificial Sequence
  Chemically synthesized
cuggcccacaagcucucca

SEQ ID NO: 876 - RNA, 19 nt, Artificial Sequence
  Chemically synthesized
gaugacuucgugcgcagca

SEQ ID NO: 877 - RNA, 19 nt, Artificial Sequence
  Chemically synthesized
acuuccgcgacaagcgcag

SEQ ID NO: 878 - RNA, 19 nt, Artificial Sequence
  Chemically synthesized
aacgccauguucuucaagc

SEQ ID NO: 879 - RNA, 19 nt, Artificial Sequence
  Chemically synthesized
ggaccuguaccuggccagc

SEQ ID NO: 880 - RNA, 19 nt, Artificial Sequence
  Chemically synthesized
gcgacgaggaggugcacgc

SEQ ID NO: 881 - RNA, 19 nt, Artificial Sequence
  Chemically synthesized
gcaagcugcccgaggucac

SEQ ID NO: 882 - RNA, 19 nt, Artificial Sequence
  Chemically synthesized
auucauugggcgccugguc

SEQ ID NO: 883 - RNA, 19 nt, Artificial Sequence
  Chemically synthesized
gaggucaccaaggacgugg

SEQ ID NO: 884 - RNA, 19 nt, Artificial Sequence
  Chemically synthesized
aagaaggaccuguaccugg

SEQ ID NO: 885 - RNA, 19 nt, Artificial Sequence
  Chemically synthesized
gacaaccguggcuucaugg

SEQ ID NO: 886 - RNA, 19 nt, Artificial Sequence
  Chemically synthesized
cugggccugacugaggcca

SEQ ID NO: 887 - RNA, 19 nt, Artificial Sequence
  Chemically synthesized
cuccaagaucaacuuccgc

SEQ ID NO: 888 - RNA, 19 nt, Artificial Sequence
  Chemically synthesized
caacuuccgcgacaagcgc

SEQ ID NO: 889 - RNA, 19 nt, Artificial Sequence
  Chemically synthesized
cucccugcuauucauuggg

SEQ ID NO: 890 - RNA, 19 nt, Artificial Sequence
  Chemically synthesized
aagcagcacuacaacugcg

SEQ ID NO: 891 - RNA, 19 nt, Artificial Sequence
  Chemically synthesized
gcgcagcagcaagcagcac

SEQ ID NO: 892 - RNA, 19 nt, Artificial Sequence
  Chemically synthesized
caggccauggccaaggacc

SEQ ID NO: 893 - RNA, 19 nt, Artificial Sequence
  Chemically synthesized
guaccaggccauggccaag

SEQ ID NO: 894 - RNA, 19 nt, Artificial Sequence
  Chemically synthesized
cuucgugcgcagcagcaag

SEQ ID NO: 895 - RNA, 19 nt, Artificial Sequence
  Chemically synthesized
cagcacuacaacugcgagc

SEQ ID NO: 896 - RNA, 19 nt, Artificial Sequence
  Chemically synthesized
uacaacuacuacgacgacg

SEQ ID NO: 897 - RNA, 19 nt, Artificial Sequence
  Chemically synthesized
gaugguggacaaccguggc

SEQ ID NO: 898 - RNA, 19 nt, Artificial Sequence
  Chemically synthesized
cuacaacugcgagcacucc

SEQ ID NO: 899 - RNA, 19 nt, Artificial Sequence
  Chemically synthesized
aaggaccuguaccuggcca

SEQ ID NO: 900 - RNA, 19 nt, Artificial Sequence
  Chemically synthesized
gcugcccgaggucaccaag

SEQ ID NO: 901 - RNA, 19 nt, Artificial Sequence
  Chemically synthesized
gacaucuacgggcgcgagg

SEQ ID NO: 902 - RNA, 19 nt, Artificial Sequence
  Chemically synthesized
ccaccacaagaugguggac

SEQ ID NO: 903 - RNA, 19 nt, Artificial Sequence
  Chemically synthesized
gcgcgacgaggaggugcac

SEQ ID NO: 904 - RNA, 19 nt, Artificial Sequence
  Chemically synthesized
cuauucauugggcgccugg

SEQ ID NO: 905 - RNA, 19 nt, Artificial Sequence
  Chemically synthesized
ccaggacaucuacgggcgc

SEQ ID NO: 906 - RNA, 19 nt, Artificial Sequence
  Chemically synthesized
aagaugguggacaaccgug

SEQ ID NO: 907 - RNA, 19 nt, Artificial Sequence
  Chemically synthesized
caggacaucuacgggcgcg

SEQ ID NO: 908 - RNA, 19 nt, Artificial Sequence
  Chemically synthesized
uccaagaucaacuuccgcg

SEQ ID NO: 909 - RNA, 19 nt, Artificial Sequence
  Chemically synthesized
gucaccaaggacguggagc

SEQ ID NO: 910 - RNA, 19 nt, Artificial Sequence
  Chemically synthesized
cugcccgaggucaccaagg

SEQ ID NO: 911 - RNA, 19 nt, Artificial Sequence
  Chemically synthesized
gaccaggacaucuacgggc

SEQ ID NO: 912 - RNA, 19 nt, Artificial Sequence
  Chemically synthesized
ccauggccaaggaccaggc

SEQ ID NO: 913 - RNA, 19 nt, Artificial Sequence
  Chemically synthesized
caccaaggacguggagcgc

SEQ ID NO: 914 - RNA, 19 nt, Artificial Sequence
  Chemically synthesized
gacaagcgcagcgcgcugc

SEQ ID NO: 915 - RNA, 19 nt, Artificial Sequence
  Chemically synthesized
caagcgcagcgcgcugcag

SEQ ID NO: 916 - RNA, 19 nt, Artificial Sequence
  Chemically synthesized
cagaccaccgacggcaagc

SEQ ID NO: 917 - RNA, 19 nt, Artificial Sequence
  Chemically synthesized
gaccaccgacggcaagcug

SEQ ID NO: 918 - RNA, 19 nt, Artificial Sequence
  Chemically synthesized
aggaccuguaccuggccag

SEQ ID NO: 919 - RNA, 19 nt, Artificial Sequence
  Chemically synthesized
cugcuauucauugggcgcc

SEQ ID NO: 920 - RNA, 19 nt, Artificial Sequence
  Chemically synthesized
ucauugggcgccugguccg

SEQ ID NO: 921 - RNA, 19 nt, Artificial Sequence
  Chemically synthesized
gcugcgcgacgaggaggug

SEQ ID NO: 922 - RNA, 19 nt, Artificial Sequence
  Chemically synthesized
cggcaagcugcccgagguc

SEQ ID NO: 923 - RNA, 19 nt, Artificial Sequence
  Chemically synthesized
ccucaucauccucaugccc

SEQ ID NO: 924 - RNA, 19 nt, Artificial Sequence
  Chemically synthesized
ccaggccauggccaaggac

SEQ ID NO: 925 - RNA, 19 nt, Artificial Sequence
  Chemically synthesized
gccauggccaaggaccagg

SEQ ID NO: 926 - RNA, 19 nt, Artificial Sequence
  Chemically synthesized
ccaccgacggcaagcugcc

SEQ ID NO: 927 - RNA, 19 nt, Artificial Sequence
  Chemically synthesized
augguggacaaccguggcu

SEQ ID NO: 928 - RNA, 19 nt, Artificial Sequence
  Chemically synthesized
cuuccgcgacaagcgcagc

SEQ ID NO: 929 - RNA, 19 nt, Artificial Sequence
  Chemically synthesized
cgcgacgaggaggugcacg

SEQ ID NO: 930 - RNA, 19 nt, Artificial Sequence
  Chemically synthesized
uggcccacaagcucuccag

SEQ ID NO: 931 - RNA, 19 nt, Artificial Sequence
  Chemically synthesized
gagcagcugcgcgacgagg

SEQ ID NO: 932 - RNA, 19 nt, Artificial Sequence
  Chemically synthesized
ugaccaggacaucuacggg

SEQ ID NO: 933 - RNA, 19 nt, Artificial Sequence
  Chemically synthesized
accaccgacggcaagcugc

SEQ ID NO: 934 - RNA, 19 nt, Artificial Sequence
  Chemically synthesized
gaaggaccuguaccuggcc

SEQ ID NO: 935 - RNA, 19 nt, Artificial Sequence
  Chemically synthesized
cauugggcgccugguccgg

SEQ ID NO: 936 - RNA, 19 nt, Artificial Sequence
  Chemically synthesized
augcaccggacaggccucu

SEQ ID NO: 937 - RNA, 19 nt, Artificial Sequence
  Chemically synthesized
aucaacuuccgcgacaagc

SEQ ID NO: 938 - RNA, 19 nt, Artificial Sequence
  Chemically synthesized
cagcugcgcgacgaggagg

SEQ ID NO: 939 - RNA, 19 nt, Artificial Sequence
  Chemically synthesized
cagaaacaccuggcugggc

SEQ ID NO: 940 - RNA, 19 nt, Artificial Sequence
  Chemically synthesized
cuacgggcgcgaggagcug

SEQ ID NO: 941 - RNA, 19 nt, Artificial Sequence
  Chemically synthesized
cgacgaggaggugcacgcc

SEQ ID NO: 942 - RNA, 19 nt, Artificial Sequence
  Chemically synthesized
uuugaccaggacaucuacg

SEQ ID NO: 943 - RNA, 19 nt, Artificial Sequence
  Chemically synthesized
guccaucaacgagugggcc

SEQ ID NO: 944 - RNA, 19 nt, Artificial Sequence
  Chemically synthesized
augacuucgugcgcagcag

SEQ ID NO: 945 - RNA, 19 nt, Artificial Sequence
  Chemically synthesized
ucccugcuauucauugggc

SEQ ID NO: 946 - RNA, 19 nt, Artificial Sequence
  Chemically synthesized
cugcgcgacgaggaggugc

SEQ ID NO: 947 - RNA, 19 nt, Artificial Sequence
  Chemically synthesized
caagcugcccgaggucacc

SEQ ID NO: 948 - RNA, 19 nt, Artificial Sequence
  Chemically synthesized
aagcugcccgaggucacca

SEQ ID NO: 949 - RNA, 19 nt, Artificial Sequence
  Chemically synthesized
uucuucaagccacacuggg

SEQ ID NO: 950 - RNA, 19 nt, Artificial Sequence
  Chemically synthesized
acaccuggcugggcugggc

SEQ ID NO: 951 - RNA, 19 nt, Artificial Sequence
  Chemically synthesized
uccaucaacgagugggccg

SEQ ID NO: 952 - RNA, 19 nt, Artificial Sequence
  Chemically synthesized
aucuacgggcgcgaggagc

SEQ ID NO: 953 - RNA, 19 nt, Artificial Sequence
  Chemically synthesized
ucgugcgcagcagcaagca

SEQ ID NO: 954 - RNA, 19 nt, Artificial Sequence
  Chemically synthesized
cgacggcaagcugcccgag

SEQ ID NO: 955 - RNA, 19 nt, Artificial Sequence
  Chemically synthesized
uucauugggcgccuggucc

SEQ ID NO: 956 - RNA, 19 nt, Artificial Sequence
  Chemically synthesized
uugaccaggacaucuacgg

SEQ ID NO: 957 - RNA, 19 nt, Artificial Sequence
  Chemically synthesized
ccuggcccacaagcucucc

SEQ ID NO: 958 - RNA, 19 nt, Artificial Sequence
  Chemically synthesized
ugacuucgugcgcagcagc

SEQ ID NO: 959 - RNA, 19 nt, Artificial Sequence
  Chemically synthesized
augaugcaccggacaggcc

SEQ ID NO: 960 - RNA, 19 nt, Artificial Sequence
  Chemically synthesized
caccgacggcaagcugccc

SEQ ID NO: 961 - RNA, 19 nt, Artificial Sequence
  Chemically synthesized
gacggcaagcugcccgagg

SEQ ID NO: 962 - RNA, 19 nt, Artificial Sequence
  Chemically synthesized
uaccaggccauggccaagg

SEQ ID NO: 963 - RNA, 19 nt, Artificial Sequence
  Chemically synthesized
uccgcgacaagcgcagcgc

SEQ ID NO: 964 - RNA, 19 nt, Artificial Sequence
  Chemically synthesized
uuccgcgacaagcgcagcg

SEQ ID NO: 965 - RNA, 19 nt, Artificial Sequence
  Chemically synthesized
aaggacguggagcgcacgg

SEQ ID NO: 966 - RNA, 19 nt, Artificial Sequence
  Chemically synthesized
uuccaccacaagauggugg

SEQ ID NO: 967 - RNA, 19 nt, Artificial Sequence
  Chemically synthesized
uacgggcgcgaggagcugc

SEQ ID NO: 968 - RNA, 19 nt, Artificial Sequence
  Chemically synthesized
aaacaccuggcugggcugg

SEQ ID NO: 969 - RNA, 19 nt, Artificial Sequence
  Chemically synthesized
aacaccuggcugggcuggg

SEQ ID NO: 970 - RNA, 19 nt, Artificial Sequence
  Chemically synthesized
auugggcgccugguccggc

SEQ ID NO: 971 - RNA, 19 nt, Artificial Sequence
  Chemically synthesized
accgacggcaagcugcccg

SEQ ID NO: 972 - RNA, 19 nt, Artificial Sequence
  Chemically synthesized
uucgugcgcagcagcaagc

SEQ ID NO: 973 - RNA, 19 nt, Artificial Sequence
  Chemically synthesized
agugcucgcaguuguagug

SEQ ID NO: 974 - RNA, 19 nt, Artificial Sequence
  Chemically synthesized
ucaccaugaagccacgguu

SEQ ID NO: 975 - RNA, 19 nt, Artificial Sequence
  Chemically synthesized
gguacagguccuucuugcc

SEQ ID NO: 976 - RNA, 19 nt, Artificial Sequence
  Chemically synthesized
gaagccacgguuguccacc

SEQ ID NO: 977 - RNA, 19 nt, Artificial Sequence
  Chemically synthesized
ugguccuuggccauggccu

SEQ ID NO: 978 - RNA, 19 nt, Artificial Sequence
  Chemically synthesized
uggacugcagcgcgcugcg

SEQ ID NO: 979 - RNA, 19 nt, Artificial Sequence
  Chemically synthesized
uguagugcugcuugcugcu

SEQ ID NO: 980 - RNA, 19 nt, Artificial Sequence
  Chemically synthesized
cguaguaguuguagaggcc

SEQ ID NO: 981 - RNA, 19 nt, Artificial Sequence
  Chemically synthesized
agccuucuucugcaucuuc

SEQ ID NO: 982 - RNA, 19 nt, Artificial Sequence
  Chemically synthesized
cccaugugucucaggagcc

SEQ ID NO: 983 - RNA, 19 nt, Artificial Sequence
  Chemically synthesized
aguuguagugcugcuugcu

SEQ ID NO: 984 - RNA, 19 nt, Artificial Sequence
  Chemically synthesized
caggucaugggucaccucc

SEQ ID NO: 985 - RNA, 19 nt, Artificial Sequence
  Chemically synthesized
agauguccuggucaaaggg

SEQ ID NO: 986 - RNA, 19 nt, Artificial Sequence
  Chemically synthesized
cacccaugugucucaggag

SEQ ID NO: 987 - RNA, 19 nt, Artificial Sequence
  Chemically synthesized
caugugucucaggagccuu

SEQ ID NO: 988 - RNA, 19 nt, Artificial Sequence
  Chemically synthesized
guugauggacugcagcgcg

SEQ ID NO: 989 - RNA, 19 nt, Artificial Sequence
  Chemically synthesized
gucaccuccaccacacccu

SEQ ID NO: 990 - RNA, 19 nt, Artificial Sequence
  Chemically synthesized
ugcucgcaguuguagugcu

SEQ ID NO: 991 - RNA, 19 nt, Artificial Sequence
  Chemically synthesized
caaugaauagcagggagcc

SEQ ID NO: 992 - RNA, 19 nt, Artificial Sequence
  Chemically synthesized
uccaggucacguugcgcgc

SEQ ID NO: 993 - RNA, 19 nt, Artificial Sequence
  Chemically synthesized
cucguugauggacugcagc

SEQ ID NO: 994 - RNA, 19 nt, Artificial Sequence
  Chemically synthesized
ucuucagcugcucuuuggu

SEQ ID NO: 995 - RNA, 19 nt, Artificial Sequence
  Chemically synthesized
gugcgcuccacguccuugg

SEQ ID NO: 996 - RNA, 19 nt, Artificial Sequence
  Chemically synthesized
caguguggcuugaagaaca

SEQ ID NO: 997 - RNA, 19 nt, Artificial Sequence
  Chemically synthesized
cuccaccacacccuugggc

SEQ ID NO: 998 - RNA, 19 nt, Artificial Sequence
  Chemically synthesized
aguaguuguagaggccugu

SEQ ID NO: 999 - RNA, 19 nt, Artificial Sequence
  Chemically synthesized
ugcugcuugcugcugcgca

SEQ ID NO: 1000 - RNA, 19 nt, Artificial Sequence
  Chemically synthesized
gucaugggucaccuccacc

SEQ ID NO: 1001 - RNA, 19 nt, Artificial Sequence
  Chemically synthesized
guagauguccuggucaaag

SEQ ID NO: 1002 - RNA, 19 nt, Artificial Sequence
  Chemically synthesized
ucaccuccaccacacccuu

SEQ ID NO: 1003 - RNA, 19 nt, Artificial Sequence
  Chemically synthesized
ugacacccacgguauagga

SEQ ID NO: 1004 - RNA, 19 nt, Artificial Sequence
  Chemically synthesized
ugccgucgguggucugcgc

SEQ ID NO: 1005 - RNA, 19 nt, Artificial Sequence
  Chemically synthesized
agugcugcuugcugcugcg

SEQ ID NO: 1006 - RNA, 19 nt, Artificial Sequence
  Chemically synthesized
ggcaugaggaugaugaggc

SEQ ID NO: 1007 - RNA, 19 nt, Artificial Sequence
  Chemically synthesized
aggaugaugaggcuggaga

SEQ ID NO: 1008 - RNA, 19 nt, Artificial Sequence
  Chemically synthesized
gccuuguucuugucaaugg

SEQ ID NO: 1009 - RNA, 19 nt, Artificial Sequence
  Chemically synthesized
ucgcaguuguagugcugcu

SEQ ID NO: 1010 - RNA, 19 nt, Artificial Sequence
  Chemically synthesized
uagaggccuguccggugca

SEQ ID NO: 1011 - RNA, 19 nt, Artificial Sequence
  Chemically synthesized
cggaaguugaucuuggagu

SEQ ID NO: 1012 - RNA, 19 nt, Artificial Sequence
  Chemically synthesized
augaagccacgguugucca

SEQ ID NO: 1013 - RNA, 19 nt, Artificial Sequence
  Chemically synthesized
uccagaucuucagcugcuc

SEQ ID NO: 1014 - RNA, 19 nt, Artificial Sequence
  Chemically synthesized
uggcaacagccuucuucug

SEQ ID NO: 1015 - RNA, 19 nt, Artificial Sequence
  Chemically synthesized
guacagguccuucuugccu

SEQ ID NO: 1016 - RNA, 19 nt, Artificial Sequence
  Chemically synthesized
gucguaguaguuguagagg

SEQ ID NO: 1017 - RNA, 19 nt, Artificial Sequence
  Chemically synthesized
auccagaucuucagcugcu

SEQ ID NO: 1018 - RNA, 19 nt, Artificial Sequence
  Chemically synthesized
ucucgucgucguaguaguu

SEQ ID NO: 1019 - RNA, 19 nt, Artificial Sequence
  Chemically synthesized
ugaccucgggcagcuugcc

SEQ ID NO: 1020 - RNA, 19 nt, Artificial Sequence
  Chemically synthesized
guuguagaggccuguccgg

SEQ ID NO: 1021 - RNA, 19 nt, Artificial Sequence
  Chemically synthesized
ccaaugaauagcagggagc

SEQ ID NO: 1022 - RNA, 19 nt, Artificial Sequence
  Chemically synthesized
ucuuggagugcucgcaguu

SEQ ID NO: 1023 - RNA, 19 nt, Artificial Sequence
  Chemically synthesized
ccaauagcacccauguguc

SEQ ID NO: 1024 - RNA, 19 nt, Artificial Sequence
  Chemically synthesized
guagaggccuguccggugc

SEQ ID NO: 1025 - RNA, 19 nt, Artificial Sequence
  Chemically synthesized
gacugcagcgcgcugcgcu

SEQ ID NO: 1026 - RNA, 19 nt, Artificial Sequence
  Chemically synthesized
guccgugcgcuccacgucc

SEQ ID NO: 1027 - RNA, 19 nt, Artificial Sequence
  Chemically synthesized
caugaggaugaugaggcug

SEQ ID NO: 1028 - RNA, 19 nt, Artificial Sequence
  Chemically synthesized
ugucgcggaaguugaucuu

SEQ ID NO: 1029 - RNA, 19 nt, Artificial Sequence
  Chemically synthesized
cuuccaggucacguugcgc

SEQ ID NO: 1030 - RNA, 19 nt, Artificial Sequence
  Chemically synthesized
aucuuggagugcucgcagu

SEQ ID NO: 1031 - RNA, 19 nt, Artificial Sequence
  Chemically synthesized
ugaagccacgguuguccac

SEQ ID NO: 1032 - RNA, 19 nt, Artificial Sequence
  Chemically synthesized
gaggcuggagagcuugugg

SEQ ID NO: 1033 - RNA, 19 nt, Artificial Sequence
  Chemically synthesized
acgguuguccaccaucuug

SEQ ID NO: 1034 - RNA, 19 nt, Artificial Sequence
  Chemically synthesized
guugaucuuggagugcucg

SEQ ID NO: 1035 - RNA, 19 nt, Artificial Sequence
  Chemically synthesized
uuggugaccucgggcagcu

SEQ ID NO: 1036 - RNA, 19 nt, Artificial Sequence
  Chemically synthesized
cucgcgcccguagaugucc

SEQ ID NO: 1037 - RNA, 19 nt, Artificial Sequence
  Chemically synthesized
ucgcgcccguagauguccu

SEQ ID NO: 1038 - RNA, 19 nt, Artificial Sequence
  Chemically synthesized
agguccuucuugccugaca

SEQ ID NO: 1039 - RNA, 19 nt, Artificial Sequence
  Chemically synthesized
ggucaccuccaccacaccc

SEQ ID NO: 1040 - RNA, 19 nt, Artificial Sequence
  Chemically synthesized
gaugaggcuggagagcuug

SEQ ID NO: 1041 - RNA, 19 nt, Artificial Sequence
  Chemically synthesized
ucugcaggucaugggucac

SEQ ID NO: 1042 - RNA, 19 nt, Artificial Sequence
  Chemically synthesized
ccaguguggcuugaagaac

SEQ ID NO: 1043 - RNA, 19 nt, Artificial Sequence
  Chemically synthesized
uccucgcgcccguagaugu

SEQ ID NO: 1044 - RNA, 19 nt, Artificial Sequence
  Chemically synthesized
aggucaugggucaccucca

SEQ ID NO: 1045 - RNA, 19 nt, Artificial Sequence
  Chemically synthesized
gcaacagccuucuucugca

SEQ ID NO: 1046 - RNA, 19 nt, Artificial Sequence
  Chemically synthesized
uuggccauggccugguaca

SEQ ID NO: 1047 - RNA, 19 nt, Artificial Sequence
  Chemically synthesized
augggucaccuccaccaca

SEQ ID NO: 1048 - RNA, 19 nt, Artificial Sequence
  Chemically synthesized
gccagguacagguccuucu

SEQ ID NO: 1049 - RNA, 19 nt, Artificial Sequence
  Chemically synthesized
uccucgucgcgcagcugcu

SEQ ID NO: 1050 - RNA, 19 nt, Artificial Sequence
  Chemically synthesized
ggcuugaagaacauggcgu

SEQ ID NO: 1051 - RNA, 19 nt, Artificial Sequence
  Chemically synthesized
cgguuguccaccaucuugu

SEQ ID NO: 1052 - RNA, 19 nt, Artificial Sequence
  Chemically synthesized
gaucuuggagugcucgcag

SEQ ID NO: 1053 - RNA, 19 nt, Artificial Sequence
  Chemically synthesized
cuugccugacaugcgugac

SEQ ID NO: 1054 - RNA, 19 nt, Artificial Sequence
  Chemically synthesized
cuucuugccugacaugcgu

SEQ ID NO: 1055 - RNA, 19 nt, Artificial Sequence
  Chemically synthesized
aggcgcccaaugaauagca

SEQ ID NO: 1056 - RNA, 19 nt, Artificial Sequence
  Chemically synthesized
ugcaccuccucgucgcgca

SEQ ID NO: 1057 - RNA, 19 nt, Artificial Sequence
  Chemically synthesized
cauccagaucuucagcugc

SEQ ID NO: 1058 - RNA, 19 nt, Artificial Sequence
  Chemically synthesized
guguuucugcaggucaugg

SEQ ID NO: 1059 - RNA, 19 nt, Artificial Sequence
  Chemically synthesized
ugaugaggcuggagagcuu

SEQ ID NO: 1060 - RNA, 19 nt, Artificial Sequence
  Chemically synthesized
guuguagugcugcuugcug

SEQ ID NO: 1061 - RNA, 19 nt, Artificial Sequence
  Chemically synthesized
aguguggcuugaagaacau

SEQ ID NO: 1062 - RNA, 19 nt, Artificial Sequence
  Chemically synthesized
gcacccaugugucucagga

SEQ ID NO: 1063 - RNA, 19 nt, Artificial Sequence
  Chemically synthesized
ggaaguugaucuuggagug

SEQ ID NO: 1064 - RNA, 19 nt, Artificial Sequence
  Chemically synthesized
cucgcaucuugucacccuu

SEQ ID NO: 1065 - RNA, 19 nt, Artificial Sequence
  Chemically synthesized
guaguuguagaggccuguc

SEQ ID NO: 1066 - RNA, 19 nt, Artificial Sequence
  Chemically synthesized
guuucugcaggucaugggu

SEQ ID NO: 1067 - RNA, 19 nt, Artificial Sequence
  Chemically synthesized
uguccaccaucuuguggug

SEQ ID NO: 1068 - RNA, 19 nt, Artificial Sequence
  Chemically synthesized
ggcaacagccuucuucugc

SEQ ID NO: 1069 - RNA, 19 nt, Artificial Sequence
  Chemically synthesized
caugggucaccuccaccac

SEQ ID NO: 1070 - RNA, 19 nt, Artificial Sequence
  Chemically synthesized
guaguaguuguagaggccu

SEQ ID NO: 1071 - RNA, 19 nt, Artificial Sequence
  Chemically synthesized
cugcaggucaugggucacc

SEQ ID NO: 1072 - RNA, 19 nt, Artificial Sequence
  Chemically synthesized
cagguuucuucaccucggc

SEQ ID NO: 1073 - RNA, 19 nt, Artificial Sequence
  Chemically synthesized
cucgucgucguaguaguug

SEQ ID NO: 1074 - RNA, 19 nt, Artificial Sequence
  Chemically synthesized
cagguacagguccuucuug

SEQ ID NO: 1075 - RNA, 19 nt, Artificial Sequence
  Chemically synthesized
aaggcgguggcguggaaca

SEQ ID NO: 1076 - RNA, 19 nt, Artificial Sequence
  Chemically synthesized
cgcccaaugaauagcaggg

SEQ ID NO: 1077 - RNA, 19 nt, Artificial Sequence
  Chemically synthesized
agucaccaugaagccacgg

SEQ ID NO: 1078 - RNA, 19 nt, Artificial Sequence
  Chemically synthesized
gucgucguaguaguuguag

SEQ ID NO: 1079 - RNA, 19 nt, Artificial Sequence
  Chemically synthesized
cucgcaguuguagugcugc

SEQ ID NO: 1080 - RNA, 19 nt, Artificial Sequence
  Chemically synthesized
aagccacgguuguccacca

SEQ ID NO: 1081 - RNA, 19 nt, Artificial Sequence
  Chemically synthesized
agcuugccgucgguggucu

SEQ ID NO: 1082 - RNA, 19 nt, Artificial Sequence
  Chemically synthesized
agcccagccagguguuucu

SEQ ID NO: 1083 - RNA, 19 nt, Artificial Sequence
  Chemically synthesized
ugcgcuccacguccuuggu

SEQ ID NO: 1084 - RNA, 19 nt, Artificial Sequence
  Chemically synthesized
gcagguuucuucaccucgg

SEQ ID NO: 1085 - RNA, 19 nt, Artificial Sequence
  Chemically synthesized
gagugcucgcaguuguagu

SEQ ID NO: 1086 - RNA, 19 nt, Artificial Sequence
  Chemically synthesized
augaggcuggagagcuugu

SEQ ID NO: 1087 - RNA, 19 nt, Artificial Sequence
  Chemically synthesized
uccgugcgcuccacguccu

SEQ ID NO: 1088 - RNA, 19 nt, Artificial Sequence
  Chemically synthesized
caggcgcccaaugaauagc

SEQ ID NO: 1089 - RNA, 19 nt, Artificial Sequence
  Chemically synthesized
ugcgcuugucgcggaaguu

SEQ ID NO: 1090 - RNA, 19 nt, Artificial Sequence
  Chemically synthesized
gaugaugaggcuggagagc

SEQ ID NO: 1091 - RNA, 19 nt, Artificial Sequence
  Chemically synthesized
gagauggcaacagccuucu

SEQ ID NO: 1092 - RNA, 19 nt, Artificial Sequence
  Chemically synthesized
cuccacguccuuggugacc

SEQ ID NO: 1093 - RNA, 19 nt, Artificial Sequence
  Chemically synthesized
accuccucgucgcgcagcu

SEQ ID NO: 1094 - RNA, 19 nt, Artificial Sequence
  Chemically synthesized
cguccuuggugaccucggg

SEQ ID NO: 1095 - RNA, 19 nt, Artificial Sequence
  Chemically synthesized
gguccuucuugccugacau

SEQ ID NO: 1096 - RNA, 19 nt, Artificial Sequence
  Chemically synthesized
cacguccuuggugaccucg

SEQ ID NO: 1097 - RNA, 19 nt, Artificial Sequence
  Chemically synthesized
gaggccuguccggugcauc

SEQ ID NO: 1098 - RNA, 19 nt, Artificial Sequence
  Chemically synthesized
gugcucgcaguuguagugc

SEQ ID NO: 1099 - RNA, 19 nt, Artificial Sequence
  Chemically synthesized
guuguccaccaucuugugg

SEQ ID NO: 1100 - RNA, 19 nt, Artificial Sequence
  Chemically synthesized
caccuccaccacacccuug

SEQ ID NO: 1101 - RNA, 19 nt, Artificial Sequence
  Chemically synthesized
cccauccagaucuucagcu

SEQ ID NO: 1102 - RNA, 19 nt, Artificial Sequence
  Chemically synthesized
uccuuggccauggccuggu

SEQ ID NO: 1103 - RNA, 19 nt, Artificial Sequence
  Chemically synthesized
guguggcuugaagaacaug

SEQ ID NO: 1104 - RNA, 19 nt, Artificial Sequence
  Chemically synthesized
gucgcggaaguugaucuug

SEQ ID NO: 1105 - RNA, 19 nt, Artificial Sequence
  Chemically synthesized
ugaggaugaugaggcugga

SEQ ID NO: 1106 - RNA, 19 nt, Artificial Sequence
  Chemically synthesized
guccuuggugaccucgggc

SEQ ID NO: 1107 - RNA, 19 nt, Artificial Sequence
  Chemically synthesized
ucaucccaguguggcuuga

SEQ ID NO: 1108 - RNA, 19 nt, Artificial Sequence
  Chemically synthesized
gcccacucguugauggacu

SEQ ID NO: 1109 - RNA, 19 nt, Artificial Sequence
  Chemically synthesized
ugcugcugcgcacgaaguc

SEQ ID NO: 1110 - RNA, 19 nt, Artificial Sequence
  Chemically synthesized
ggaugaugaggcuggagag

SEQ ID NO: 1111 - RNA, 19 nt, Artificial Sequence
  Chemically synthesized
cuugccgucgguggucugc

SEQ ID NO: 1112 - RNA, 19 nt, Artificial Sequence
  Chemically synthesized
caacagccuucuucugcau

SEQ ID NO: 1113 - RNA, 19 nt, Artificial Sequence
  Chemically synthesized
caccaugaagccacgguug

SEQ ID NO: 1114 - RNA, 19 nt, Artificial Sequence
  Chemically synthesized
ccuucucgucgucguagua

SEQ ID NO: 1115 - RNA, 19 nt, Artificial Sequence
  Chemically synthesized
ggagauggcaacagccuuc

SEQ ID NO: 1116 - RNA, 19 nt, Artificial Sequence
  Chemically synthesized
cgcuccacguccuugguga

SEQ ID NO: 1117 - RNA, 19 nt, Artificial Sequence
  Chemically synthesized
ccauccagaucuucagcug

SEQ ID NO: 1118 - RNA, 19 nt, Artificial Sequence
  Chemically synthesized
auggccucagucaggccca

SEQ ID NO: 1119 - RNA, 19 nt, Artificial Sequence
  Chemically synthesized
gucaccaugaagccacggu

SEQ ID NO: 1120 - RNA, 19 nt, Artificial Sequence
  Chemically synthesized
cccacucguugauggacug

SEQ ID NO: 1121 - RNA, 19 nt, Artificial Sequence
  Chemically synthesized
ucgggcagcuugccgucgg

SEQ ID NO: 1122 - RNA, 19 nt, Artificial Sequence
  Chemically synthesized
ugcagcgcgcugcgcuugu

SEQ ID NO: 1123 - RNA, 19 nt, Artificial Sequence
  Chemically synthesized
cagcccagccagguguuuc

SEQ ID NO: 1124 - RNA, 19 nt, Artificial Sequence
  Chemically synthesized
ccaugugucucaggagccu

SEQ ID NO: 1125 - RNA, 19 nt, Artificial Sequence
  Chemically synthesized
cgugcgcuccacguccuug

SEQ ID NO: 1126 - RNA, 19 nt, Artificial Sequence
  Chemically synthesized
ccacucguugauggacugc

SEQ ID NO: 1127 - RNA, 19 nt, Artificial Sequence
  Chemically synthesized
ccacgguuguccaccaucu

SEQ ID NO: 1128 - RNA, 19 nt, Artificial Sequence
  Chemically synthesized
acugcagcgcgcugcgcuu

SEQ ID NO: 1129 - RNA, 19 nt, Artificial Sequence
  Chemically synthesized
guccuucuugccugacaug

SEQ ID NO: 1130 - RNA, 19 nt, Artificial Sequence
  Chemically synthesized
cucaucccaguguggcuug

SEQ ID NO: 1131 - RNA, 19 nt, Artificial Sequence
  Chemically synthesized
cagccuucuucugcaucuu

SEQ ID NO: 1132 - RNA, 19 nt, Artificial Sequence
  Chemically synthesized
cugguccuuggccauggcc

SEQ ID NO: 1133 - RNA, 19 nt, Artificial Sequence
  Chemically synthesized
gcugcuugcugcugcgcac

SEQ ID NO: 1134 - RNA, 19 nt, Artificial Sequence
  Chemically synthesized
cuuggagugcucgcaguug

SEQ ID NO: 1135 - RNA, 19 nt, Artificial Sequence
  Chemically synthesized
uggagugcucgcaguugua

SEQ ID NO: 1136 - RNA, 19 nt, Artificial Sequence
  Chemically synthesized
ggccuuguucuugucaaug

SEQ ID NO: 1137 - RNA, 19 nt, Artificial Sequence
  Chemically synthesized
gcaguuguagugcugcuug

SEQ ID NO: 1138 - RNA, 19 nt, Artificial Sequence
  Chemically synthesized
aggcgguggcguggaacac

SEQ ID NO: 1139 - RNA, 19 nt, Artificial Sequence
  Chemically synthesized
gcgcccaaugaauagcagg

SEQ ID NO: 1140 - RNA, 19 nt, Artificial Sequence
  Chemically synthesized
ggcuggagagcuugugggc

SEQ ID NO: 1141 - RNA, 19 nt, Artificial Sequence
  Chemically synthesized
guagugcugcuugcugcug

SEQ ID NO: 1142 - RNA, 19 nt, Artificial Sequence
  Chemically synthesized
aggccuguccggugcauca

SEQ ID NO: 1143 - RNA, 19 nt, Artificial Sequence
  Chemically synthesized
cgcuugucgcggaaguuga

SEQ ID NO: 1144 - RNA, 19 nt, Artificial Sequence
  Chemically synthesized
acagguccuucuugccuga

SEQ ID NO: 1145 - RNA, 19 nt, Artificial Sequence
  Chemically synthesized
uugcugcugcgcacgaagu

SEQ ID NO: 1146 - RNA, 19 nt, Artificial Sequence
  Chemically synthesized
accaugaagccacgguugu

SEQ ID NO: 1147 - RNA, 19 nt, Artificial Sequence
  Chemically synthesized
aggagauggcaacagccuu

SEQ ID NO: 1148 - RNA, 19 nt, Artificial Sequence
  Chemically synthesized
cuccucgucgcgcagcugc

SEQ ID NO: 1149 - RNA, 19 nt, Artificial Sequence
  Chemically synthesized
accaggcgcccaaugaaua

SEQ ID NO: 1150 - RNA, 19 nt, Artificial Sequence
  Chemically synthesized
uccaccaucuuguggugga

SEQ ID NO: 1151 - RNA, 19 nt, Artificial Sequence
  Chemically synthesized
gagagcuugugggccaggg

SEQ ID NO: 1152 - RNA, 19 nt, Artificial Sequence
  Chemically synthesized
cgcccguagauguccuggu

SEQ ID NO: 1153 - RNA, 19 nt, Artificial Sequence
  Chemically synthesized
gccuguccggugcaucauc

SEQ ID NO: 1154 - RNA, 19 nt, Artificial Sequence
  Chemically synthesized
cuugaagaacauggcguug

SEQ ID NO: 1155 - RNA, 19 nt, Artificial Sequence
  Chemically synthesized
accucgggcagcuugccgu

SEQ ID NO: 1156 - RNA, 19 nt, Artificial Sequence
  Chemically synthesized
gauggacugcagcgcgcug

SEQ ID NO: 1157 - RNA, 19 nt, Artificial Sequence
  Chemically synthesized
ccuccaccacacccuuggg

SEQ ID NO: 1158 - RNA, 19 nt, Artificial Sequence
  Chemically synthesized
ugccugguccuuggccaug

SEQ ID NO: 1159 - RNA, 19 nt, Artificial Sequence
  Chemically synthesized
gaggaugaugaggcuggag

SEQ ID NO: 1160 - RNA, 19 nt, Artificial Sequence
  Chemically synthesized
agcuccucgcgcccguaga

SEQ ID NO: 1161 - RNA, 19 nt, Artificial Sequence
  Chemically synthesized
gcuggagagcuugugggcc

SEQ ID NO: 1162 - RNA, 19 nt, Artificial Sequence
  Chemically synthesized
cagguccuucuugccugac

SEQ ID NO: 1163 - RNA, 19 nt, Artificial Sequence
  Chemically synthesized
cuccucgcgcccguagaug

SEQ ID NO: 1164 - RNA, 19 nt, Artificial Sequence
  Chemically synthesized
cugcuugcugcugcgcacg

SEQ ID NO: 1165 - RNA, 19 nt, Artificial Sequence
  Chemically synthesized
gcaugaggaugaugaggcu

SEQ ID NO: 1166 - RNA, 19 nt, Artificial Sequence
  Chemically synthesized
caucccaguguggcuugaa

SEQ ID NO: 1167 - RNA, 19 nt, Artificial Sequence
  Chemically synthesized
agauggcaacagccuucuu

SEQ ID NO: 1168 - RNA, 19 nt, Artificial Sequence
  Chemically synthesized
gggucaccuccaccacacc

SEQ ID NO: 1169 - RNA, 19 nt, Artificial Sequence
  Chemically synthesized
gcaggucaugggucaccuc

SEQ ID NO: 1170 - RNA, 19 nt, Artificial Sequence
  Chemically synthesized
ggucaugggucaccuccac

SEQ ID NO: 1171 - RNA, 19 nt, Artificial Sequence
  Chemically synthesized
gguuguccaccaucuugug

SEQ ID NO: 1172 - RNA, 19 nt, Artificial Sequence
  Chemically synthesized
uggagagcuugugggccag

SEQ ID NO: 1173 - RNA, 19 nt, Artificial Sequence
  Chemically synthesized
ugcugcgcacgaagucauc

SEQ ID NO: 1174 - RNA, 19 nt, Artificial Sequence
  Chemically synthesized
cugcgcuugucgcggaagu

SEQ ID NO: 1175 - RNA, 19 nt, Artificial Sequence
  Chemically synthesized
gcuugaagaacauggcguu

SEQ ID NO: 1176 - RNA, 19 nt, Artificial Sequence
  Chemically synthesized
gcuggccagguacaggucc

SEQ ID NO: 1177 - RNA, 19 nt, Artificial Sequence
  Chemically synthesized
gcgugcaccuccucgucgc

SEQ ID NO: 1178 - RNA, 19 nt, Artificial Sequence
  Chemically synthesized
gugaccucgggcagcuugc

SEQ ID NO: 1179 - RNA, 19 nt, Artificial Sequence
  Chemically synthesized
gaccaggcgcccaaugaau

SEQ ID NO: 1180 - RNA, 19 nt, Artificial Sequence
  Chemically synthesized
ccacguccuuggugaccuc

SEQ ID NO: 1181 - RNA, 19 nt, Artificial Sequence
  Chemically synthesized
ccagguacagguccuucuu

SEQ ID NO: 1182 - RNA, 19 nt, Artificial Sequence
  Chemically synthesized
ccaugaagccacgguuguc

SEQ ID NO: 1183 - RNA, 19 nt, Artificial Sequence
  Chemically synthesized
uggccucagucaggcccag

SEQ ID NO: 1184 - RNA, 19 nt, Artificial Sequence
  Chemically synthesized
gcggaaguugaucuuggag

SEQ ID NO: 1185 - RNA, 19 nt, Artificial Sequence
  Chemically synthesized
gcgcuugucgcggaaguug

SEQ ID NO: 1186 - RNA, 19 nt, Artificial Sequence
  Chemically synthesized
cccaaugaauagcagggag

SEQ ID NO: 1187 - RNA, 19 nt, Artificial Sequence
  Chemically synthesized
cgcaguuguagugcugcuu

SEQ ID NO: 1188 - RNA, 19 nt, Artificial Sequence
  Chemically synthesized
gugcugcuugcugcugcgc

SEQ ID NO: 1189 - RNA, 19 nt, Artificial Sequence
  Chemically synthesized
gguccuuggccauggccug

SEQ ID NO: 1190 - RNA, 19 nt, Artificial Sequence
  Chemically synthesized
cuuggccauggccugguac

SEQ ID NO: 1191 - RNA, 19 nt, Artificial Sequence
  Chemically synthesized
cuugcugcugcgcacgaag

SEQ ID NO: 1192 - RNA, 19 nt, Artificial Sequence
  Chemically synthesized
gcucgcaguuguagugcug

SEQ ID NO: 1193 - RNA, 19 nt, Artificial Sequence
  Chemically synthesized
cgucgucguaguaguugua

SEQ ID NO: 1194 - RNA, 19 nt, Artificial Sequence
  Chemically synthesized
gccacgguuguccaccauc

SEQ ID NO: 1195 - RNA, 19 nt, Artificial Sequence
  Chemically synthesized
ggagugcucgcaguuguag

SEQ ID NO: 1196 - RNA, 19 nt, Artificial Sequence
  Chemically synthesized
uggccagguacagguccuu

SEQ ID NO: 1197 - RNA, 19 nt, Artificial Sequence
  Chemically synthesized
cuuggugaccucgggcagc

SEQ ID NO: 1198 - RNA, 19 nt, Artificial Sequence
  Chemically synthesized
ccucgcgcccguagauguc

SEQ ID NO: 1199 - RNA, 19 nt, Artificial Sequence
  Chemically synthesized
guccaccaucuuguggugg

SEQ ID NO: 1200 - RNA, 19 nt, Artificial Sequence
  Chemically synthesized
gugcaccuccucgucgcgc

SEQ ID NO: 1201 - RNA, 19 nt, Artificial Sequence
  Chemically synthesized
ccaggcgcccaaugaauag

SEQ ID NO: 1202 - RNA, 19 nt, Artificial Sequence
  Chemically synthesized
gcgcccguagauguccugg

SEQ ID NO: 1203 - RNA, 19 nt, Artificial Sequence
  Chemically synthesized
cacgguuguccaccaucuu

SEQ ID NO: 1204 - RNA, 19 nt, Artificial Sequence
  Chemically synthesized
cgcgcccguagauguccug

SEQ ID NO: 1205 - RNA, 19 nt, Artificial Sequence
  Chemically synthesized
cgcggaaguugaucuugga

SEQ ID NO: 1206 - RNA, 19 nt, Artificial Sequence
  Chemically synthesized
gcuccacguccuuggugac

SEQ ID NO: 1207 - RNA, 19 nt, Artificial Sequence
  Chemically synthesized
ccuuggugaccucgggcag

SEQ ID NO: 1208 - RNA, 19 nt, Artificial Sequence
  Chemically synthesized
gcccguagauguccugguc

SEQ ID NO: 1209 - RNA, 19 nt, Artificial Sequence
  Chemically synthesized
gccugguccuuggccaugg

SEQ ID NO: 1210 - RNA, 19 nt, Artificial Sequence
  Chemically synthesized
gcgcuccacguccuuggug

SEQ ID NO: 1211 - RNA, 19 nt, Artificial Sequence
  Chemically synthesized
gcagcgcgcugcgcuuguc

SEQ ID NO: 1212 - RNA, 19 nt, Artificial Sequence
  Chemically synthesized
cugcagcgcgcugcgcuug

SEQ ID NO: 1213 - RNA, 19 nt, Artificial Sequence
  Chemically synthesized
gcuugccgucgguggucug

SEQ ID NO: 1214 - RNA, 19 nt, Artificial Sequence
  Chemically synthesized
cagcuugccgucggugguc

SEQ ID NO: 1215 - RNA, 19 nt, Artificial Sequence
  Chemically synthesized
cuggccagguacagguccu

SEQ ID NO: 1216 - RNA, 19 nt, Artificial Sequence
  Chemically synthesized
ggcgcccaaugaauagcag

SEQ ID NO: 1217 - RNA, 19 nt, Artificial Sequence
  Chemically synthesized
cggaccaggcgcccaauga

SEQ ID NO: 1218 - RNA, 19 nt, Artificial Sequence
  Chemically synthesized
caccuccucgucgcgcagc

SEQ ID NO: 1219 - RNA, 19 nt, Artificial Sequence
  Chemically synthesized
gaccucgggcagcuugccg

SEQ ID NO: 1220 - RNA, 19 nt, Artificial Sequence
  Chemically synthesized
gggcaugaggaugaugagg

SEQ ID NO: 1221 - RNA, 19 nt, Artificial Sequence
  Chemically synthesized
guccuuggccauggccugg

SEQ ID NO: 1222 - RNA, 19 nt, Artificial Sequence
  Chemically synthesized
ccugguccuuggccauggc

SEQ ID NO: 1223 - RNA, 19 nt, Artificial Sequence
  Chemically synthesized
ggcagcuugccgucggugg

SEQ ID NO: 1224 - RNA, 19 nt, Artificial Sequence
  Chemically synthesized
agccacgguuguccaccau

SEQ ID NO: 1225 - RNA, 19 nt, Artificial Sequence
  Chemically synthesized
gcugcgcuugucgcggaag

SEQ ID NO: 1226 - RNA, 19 nt, Artificial Sequence
  Chemically synthesized
cgugcaccuccucgucgcg

SEQ ID NO: 1227 - RNA, 19 nt, Artificial Sequence
  Chemically synthesized
cuggagagcuugugggcca

SEQ ID NO: 1228 - RNA, 19 nt, Artificial Sequence
  Chemically synthesized
ccucgucgcgcagcugcuc

SEQ ID NO: 1229 - RNA, 19 nt, Artificial Sequence
  Chemically synthesized
cccguagauguccugguca

SEQ ID NO: 1230 - RNA, 19 nt, Artificial Sequence
  Chemically synthesized
gcagcuugccgucgguggu

SEQ ID NO: 1231 - RNA, 19 nt, Artificial Sequence
  Chemically synthesized
ggccagguacagguccuuc

SEQ ID NO: 1232 - RNA, 19 nt, Artificial Sequence
  Chemically synthesized
ccggaccaggcgcccaaug

SEQ ID NO: 1233 - RNA, 19 nt, Artificial Sequence
  Chemically synthesized
agaggccuguccggugcau

SEQ ID NO: 1234 - RNA, 19 nt, Artificial Sequence
  Chemically synthesized
gcuugucgcggaaguugau

SEQ ID NO: 1235 - RNA, 19 nt, Artificial Sequence
  Chemically synthesized
ccuccucgucgcgcagcug

SEQ ID NO: 1236 - RNA, 19 nt, Artificial Sequence
  Chemically synthesized
gcccagccagguguuucug

SEQ ID NO: 1237 - RNA, 19 nt, Artificial Sequence
  Chemically synthesized
cagcuccucgcgcccguag

SEQ ID NO: 1238 - RNA, 19 nt, Artificial Sequence
  Chemically synthesized
ggcgugcaccuccucgucg

SEQ ID NO: 1239 - RNA, 19 nt, Artificial Sequence
  Chemically synthesized
cguagauguccuggucaaa

SEQ ID NO: 1240 - RNA, 19 nt, Artificial Sequence
  Chemically synthesized
ggcccacucguugauggac

SEQ ID NO: 1241 - RNA, 19 nt, Artificial Sequence
  Chemically synthesized
cugcugcgcacgaagucau

SEQ ID NO: 1242 - RNA, 19 nt, Artificial Sequence
  Chemically synthesized
gcccaaugaauagcaggga

SEQ ID NO: 1243 - RNA, 19 nt, Artificial Sequence
  Chemically synthesized
gcaccuccucgucgcgcag

SEQ ID NO: 1244 - RNA, 19 nt, Artificial Sequence
  Chemically synthesized
ggugaccucgggcagcuug

SEQ ID NO: 1245 - RNA, 19 nt, Artificial Sequence
  Chemically synthesized
uggugaccucgggcagcuu

SEQ ID NO: 1246 - RNA, 19 nt, Artificial Sequence
  Chemically synthesized
cccaguguggcuugaagaa

SEQ ID NO: 1247 - RNA, 19 nt, Artificial Sequence
  Chemically synthesized
gcccagcccagccaggugu

SEQ ID NO: 1248 - RNA, 19 nt, Artificial Sequence
  Chemically synthesized
cggcccacucguugaugga

SEQ ID NO: 1249 - RNA, 19 nt, Artificial Sequence
  Chemically synthesized
gcuccucgcgcccguagau

SEQ ID NO: 1250 - RNA, 19 nt, Artificial Sequence
  Chemically synthesized
ugcuugcugcugcgcacga

SEQ ID NO: 1251 - RNA, 19 nt, Artificial Sequence
  Chemically synthesized
cucgggcagcuugccgucg

SEQ ID NO: 1252 - RNA, 19 nt, Artificial Sequence
  Chemically synthesized
ggaccaggcgcccaaugaa

SEQ ID NO: 1253 - RNA, 19 nt, Artificial Sequence
  Chemically synthesized
ccguagauguccuggucaa

SEQ ID NO: 1254 - RNA, 19 nt, Artificial Sequence
  Chemically synthesized
ggagagcuugugggccagg

SEQ ID NO: 1255 - RNA, 19 nt, Artificial Sequence
  Chemically synthesized
gcugcugcgcacgaaguca

SEQ ID NO: 1256 - RNA, 19 nt, Artificial Sequence
  Chemically synthesized
ggccuguccggugcaucau

SEQ ID NO: 1257 - RNA, 19 nt, Artificial Sequence
  Chemically synthesized
gggcagcuugccgucggug

SEQ ID NO: 1258 - RNA, 19 nt, Artificial Sequence
  Chemically synthesized
ccucgggcagcuugccguc

SEQ ID NO: 1259 - RNA, 19 nt, Artificial Sequence
  Chemically synthesized
ccuuggccauggccuggua

SEQ ID NO: 1260 - RNA, 19 nt, Artificial Sequence
  Chemically synthesized
gcgcugcgcuugucgcgga

SEQ ID NO: 1261 - RNA, 19 nt, Artificial Sequence
  Chemically synthesized
cgcugcgcuugucgcggaa

SEQ ID NO: 1262 - RNA, 19 nt, Artificial Sequence
  Chemically synthesized
ccgugcgcuccacguccuu

SEQ ID NO: 1263 - RNA, 19 nt, Artificial Sequence
  Chemically synthesized
ccaccaucuugugguggaa

SEQ ID NO: 1264 - RNA, 19 nt, Artificial Sequence
  Chemically synthesized
gcagcuccucgcgcccgua

SEQ ID NO: 1265 - RNA, 19 nt, Artificial Sequence
  Chemically synthesized
ccagcccagccagguguuu

SEQ ID NO: 1266 - RNA, 19 nt, Artificial Sequence
  Chemically synthesized
cccagcccagccagguguu

SEQ ID NO: 1267 - RNA, 19 nt, Artificial Sequence
  Chemically synthesized
gccggaccaggcgcccaau

SEQ ID NO: 1268 - RNA, 19 nt, Artificial Sequence
  Chemically synthesized
cgggcagcuugccgucggu

SEQ ID NO: 1269 - RNA, 19 nt, Artificial Sequence
  Chemically synthesized
gcuugcugcugcgcacgaa

SEQ ID NO: 1270 - RNA, 19 nt, Artificial Sequence
  Chemically synthesized
agccuuuguugcuaucaaa

SEQ ID NO: 1271 - RNA, 19 nt, Artificial Sequence
  Chemically synthesized
gccuaagggugacaagaua

SEQ ID NO: 1272 - RNA, 19 nt, Artificial Sequence
  Chemically synthesized
ggccuaagggugacaagaa

SEQ ID NO: 1273 - RNA, 19 nt, Artificial Sequence
  Chemically synthesized
ccucaaucaguauucauaa

SEQ ID NO: 1274 - RNA, 19 nt, Artificial Sequence
  Chemically synthesized
ggcggauugagaaggagca

SEQ ID NO: 1275 - RNA, 19 nt, Artificial Sequence
  Chemically synthesized
ggcaguggagaacauccua

SEQ ID NO: 1276 - RNA, 19 nt, Artificial Sequence
  Chemically synthesized
gggucagccagcccucuua

SEQ ID NO: 1277 - RNA, 19 nt, Artificial Sequence
  Chemically synthesized
gggugacaagaugcgagaa

SEQ ID NO: 1278 - RNA, 19 nt, Artificial Sequence
  Chemically synthesized
ggaccaggcaguggagaaa

SEQ ID NO: 1279 - RNA, 19 nt, Artificial Sequence
  Chemically synthesized
gagacacaugggugcuaua

SEQ ID NO: 1280 - RNA, 19 nt, Artificial Sequence
  Chemically synthesized
guuggagcguggaaaaaaa

SEQ ID NO: 1281 - RNA, 19 nt, Artificial Sequence
  Chemically synthesized
ggaacaugagccuuuguua

SEQ ID NO: 1282 - RNA, 19 nt, Artificial Sequence
  Chemically synthesized
gccauguucuucaagccaa

SEQ ID NO: 1283 - RNA, 19 nt, Artificial Sequence
  Chemically synthesized
ggauugagaaggagcucca

SEQ ID NO: 1284 - RNA, 19 nt, Artificial Sequence
  Chemically synthesized
gggaugaacuuuuuguuua

SEQ ID NO: 1285 - RNA, 19 nt, Artificial Sequence
  Chemically synthesized
gccgcagugaggcggauua

SEQ ID NO: 1286 - RNA, 19 nt, Artificial Sequence
  Chemically synthesized
ggaccuucccagcuagaaa

SEQ ID NO: 1287 - RNA, 19 nt, Artificial Sequence
  Chemically synthesized
gaccuucccagcuagaaua

SEQ ID NO: 1288 - RNA, 19 nt, Artificial Sequence
  Chemically synthesized
ccugugagaccaaauugaa

SEQ ID NO: 1289 - RNA, 19 nt, Artificial Sequence
  Chemically synthesized
uggagaacauccuggugua

SEQ ID NO: 1290 - RNA, 19 nt, Artificial Sequence
  Chemically synthesized
gccuuuguugcuaucaaua

SEQ ID NO: 1291 - RNA, 19 nt, Artificial Sequence
  Chemically synthesized
ccgccuuugaguuggacaa

SEQ ID NO: 1292 - RNA, 19 nt, Artificial Sequence
  Chemically synthesized
caggcaguggagaacauca

SEQ ID NO: 1293 - RNA, 19 nt, Artificial Sequence
  Chemically synthesized
caccugugagaccaaauua

SEQ ID NO: 1294 - RNA, 19 nt, Artificial Sequence
  Chemically synthesized
gggaagaugcagaagaaga

SEQ ID NO: 1295 - RNA, 19 nt, Artificial Sequence
  Chemically synthesized
ggccauugacaagaacaaa

SEQ ID NO: 1296 - RNA, 19 nt, Artificial Sequence
  Chemically synthesized
gccuuugaguuggacacaa

SEQ ID NO: 1297 - RNA, 19 nt, Artificial Sequence
  Chemically synthesized
agcggaccuucccagcuaa

SEQ ID NO: 1298 - RNA, 19 nt, Artificial Sequence
  Chemically synthesized
gaagaaggcuguugccaua

SEQ ID NO: 1299 - RNA, 19 nt, Artificial Sequence
  Chemically synthesized
acaagaugcgagacgagua

SEQ ID NO: 1300 - RNA, 19 nt, Artificial Sequence
  Chemically synthesized
gaggcggauugagaaggaa

SEQ ID NO: 1301 - RNA, 19 nt, Artificial Sequence
  Chemically synthesized
ggacaaccguggcuucaua

SEQ ID NO: 1302 - RNA, 19 nt, Artificial Sequence
  Chemically synthesized
cauauuuauagccagguaa

SEQ ID NO: 1303 - RNA, 19 nt, Artificial Sequence
  Chemically synthesized
cgacgacgagaaggaaaaa

SEQ ID NO: 1304 - RNA, 19 nt, Artificial Sequence
  Chemically synthesized
cucaccugugagaccaaaa

SEQ ID NO: 1305 - RNA, 19 nt, Artificial Sequence
  Chemically synthesized
gcggcucccugcuauucaa

SEQ ID NO: 1306 - RNA, 19 nt, Artificial Sequence
  Chemically synthesized
agaacauccuggugucaca

SEQ ID NO: 1307 - RNA, 19 nt, Artificial Sequence
  Chemically synthesized
cacacugggaugagaaaua

SEQ ID NO: 1308 - RNA, 19 nt, Artificial Sequence
  Chemically synthesized
gcuagaauucacuccacua

SEQ ID NO: 1309 - RNA, 19 nt, Artificial Sequence
  Chemically synthesized
ccuucaucuuccuagugca

SEQ ID NO: 1310 - RNA, 19 nt, Artificial Sequence
  Chemically synthesized
ugcuaucaauccaagaaca

SEQ ID NO: 1311 - RNA, 19 nt, Artificial Sequence
  Chemically synthesized
ggaagaugcagaagaagga

SEQ ID NO: 1312 - RNA, 19 nt, Artificial Sequence
  Chemically synthesized
caugagccuuuguugcuaa

SEQ ID NO: 1313 - RNA, 19 nt, Artificial Sequence
  Chemically synthesized
gcggauugagaaggagcua

SEQ ID NO: 1314 - RNA, 19 nt, Artificial Sequence
  Chemically synthesized
ugcaguccaucaacgagua

SEQ ID NO: 1315 - RNA, 19 nt, Artificial Sequence
  Chemically synthesized
gcacugcggagaaguugaa

SEQ ID NO: 1316 - RNA, 19 nt, Artificial Sequence
  Chemically synthesized
ccaggcaguggagaacaua

SEQ ID NO: 1317 - RNA, 19 nt, Artificial Sequence
  Chemically synthesized
ggcaagaaggaccuguaca

SEQ ID NO: 1318 - RNA, 19 nt, Artificial Sequence
  Chemically synthesized
cucuacaacuacuacgaca

SEQ ID NO: 1319 - RNA, 19 nt, Artificial Sequence
  Chemically synthesized
cuucccagcuagaauucaa

SEQ ID NO: 1320 - RNA, 19 nt, Artificial Sequence
  Chemically synthesized
aggcggauugagaaggaga

SEQ ID NO: 1321 - RNA, 19 nt, Artificial Sequence
  Chemically synthesized
gguccuauaccguggguga

SEQ ID NO: 1322 - RNA, 19 nt, Artificial Sequence
  Chemically synthesized
gcaagaaggaccuguacca

SEQ ID NO: 1323 - RNA, 19 nt, Artificial Sequence
  Chemically synthesized
ccgugggugucaugaugaa

SEQ ID NO: 1324 - RNA, 19 nt, Artificial Sequence
  Chemically synthesized
gaugcgagacgaguuauaa

SEQ ID NO: 1325 - RNA, 19 nt, Artificial Sequence
  Chemically synthesized
ggcagugcugagcgccgaa

SEQ ID NO: 1326 - RNA, 19 nt, Artificial Sequence
  Chemically synthesized
cagcuagaauucacuccaa

SEQ ID NO: 1327 - RNA, 19 nt, Artificial Sequence
  Chemically synthesized
gagcuucgcugaugacuua

SEQ ID NO: 1328 - RNA, 19 nt, Artificial Sequence
  Chemically synthesized
cuuugaguuggacacagaa

SEQ ID NO: 1329 - RNA, 19 nt, Artificial Sequence
  Chemically synthesized
gguggacaaccguggcuua

SEQ ID NO: 1330 - RNA, 19 nt, Artificial Sequence
  Chemically synthesized
gccucaucauccucaugca

SEQ ID NO: 1331 - RNA, 19 nt, Artificial Sequence
  Chemically synthesized
accaggcaguggagaacaa

SEQ ID NO: 1332 - RNA, 19 nt, Artificial Sequence
  Chemically synthesized
ccugccucaaucaguauua

SEQ ID NO: 1333 - RNA, 19 nt, Artificial Sequence
  Chemically synthesized
gaucaagccugccucaaua

SEQ ID NO: 1334 - RNA, 19 nt, Artificial Sequence
  Chemically synthesized
cagacucuggucaagaaga

SEQ ID NO: 1335 - RNA, 19 nt, Artificial Sequence
  Chemically synthesized
cgcgcugcaguccaucaaa

SEQ ID NO: 1336 - RNA, 19 nt, Artificial Sequence
  Chemically synthesized
cuggcacugcggagaagua

SEQ ID NO: 1337 - RNA, 19 nt, Artificial Sequence
  Chemically synthesized
ccagcucuaucccaaccua

SEQ ID NO: 1338 - RNA, 19 nt, Artificial Sequence
  Chemically synthesized
agggugugguggaggugaa

SEQ ID NO: 1339 - RNA, 19 nt, Artificial Sequence
  Chemically synthesized
agugaggcggauugagaaa

SEQ ID NO: 1340 - RNA, 19 nt, Artificial Sequence
  Chemically synthesized
cggacaggccucuacaaca

SEQ ID NO: 1341 - RNA, 19 nt, Artificial Sequence
  Chemically synthesized
cgacgagaaggaaaagcua

SEQ ID NO: 1342 - RNA, 19 nt, Artificial Sequence
  Chemically synthesized
aggccaaggcagugcugaa

SEQ ID NO: 1343 - RNA, 19 nt, Artificial Sequence
  Chemically synthesized
gccucagggugcacacaga

SEQ ID NO: 1344 - RNA, 19 nt, Artificial Sequence
  Chemically synthesized
ggaugagaaauuccaccaa

SEQ ID NO: 1345 - RNA, 19 nt, Artificial Sequence
  Chemically synthesized
agaaggaaaagcugcaaaa

SEQ ID NO: 1346 - RNA, 19 nt, Artificial Sequence
  Chemically synthesized
agcucuaucccaaccucua

SEQ ID NO: 1347 - RNA, 19 nt, Artificial Sequence
  Chemically synthesized
ugacaagaugcgagacgaa

SEQ ID NO: 1348 - RNA, 19 nt, Artificial Sequence
  Chemically synthesized
agaaggagcucccaggaga

SEQ ID NO: 1349 - RNA, 19 nt, Artificial Sequence
  Chemically synthesized
ccuucucaccugugagaca

SEQ ID NO: 1350 - RNA, 19 nt, Artificial Sequence
  Chemically synthesized
ggcuucugggcagacucua

SEQ ID NO: 1351 - RNA, 19 nt, Artificial Sequence
  Chemically synthesized
ccagccucaucauccucaa

SEQ ID NO: 1352 - RNA, 19 nt, Artificial Sequence
  Chemically synthesized
ccaaaggcuccugagacaa

SEQ ID NO: 1353 - RNA, 19 nt, Artificial Sequence
  Chemically synthesized
ggaccugggccauagucaa

SEQ ID NO: 1354 - RNA, 19 nt, Artificial Sequence
  Chemically synthesized
gggugucaugaugaugcaa

SEQ ID NO: 1355 - RNA, 19 nt, Artificial Sequence
  Chemically synthesized
guaccagccuuggauacua

SEQ ID NO: 1356 - RNA, 19 nt, Artificial Sequence
  Chemically synthesized
ggcuguugccaucuccuua

SEQ ID NO: 1357 - RNA, 19 nt, Artificial Sequence
  Chemically synthesized
cgcagugaggcggauugaa

SEQ ID NO: 1358 - RNA, 19 nt, Artificial Sequence
  Chemically synthesized
ccaaggacguggagcgcaa

SEQ ID NO: 1359 - RNA, 19 nt, Artificial Sequence
  Chemically synthesized
ggcuccugagacacaugga

SEQ ID NO: 1360 - RNA, 19 nt, Artificial Sequence
  Chemically synthesized
gcugcaguccaucaacgaa

SEQ ID NO: 1361 - RNA, 19 nt, Artificial Sequence
  Chemically synthesized
ccagguaccuucucaccua

SEQ ID NO: 1362 - RNA, 19 nt, Artificial Sequence
  Chemically synthesized
gcagcgcgcugcaguccaa

SEQ ID NO: 1363 - RNA, 19 nt, Artificial Sequence
  Chemically synthesized
gagaccaaauugagcuaga

SEQ ID NO: 1364 - RNA, 19 nt, Artificial Sequence
  Chemically synthesized
gccgccgaggugaagaaaa

SEQ ID NO: 1365 - RNA, 19 nt, Artificial Sequence
  Chemically synthesized
gcagacucuggucaagaaa

SEQ ID NO: 1366 - RNA, 19 nt, Artificial Sequence
  Chemically synthesized
cuagaauucacuccacuua

SEQ ID NO: 1367 - RNA, 19 nt, Artificial Sequence
  Chemically synthesized
gcaguggagaacauccuga

SEQ ID NO: 1368 - RNA, 19 nt, Artificial Sequence
  Chemically synthesized
cgcaugucaggcaagaaga

SEQ ID NO: 1369 - RNA, 19 nt, Artificial Sequence
  Chemically synthesized
cggauugagaaggagcuca

SEQ ID NO: 1370 - RNA, 19 nt, Artificial Sequence
  Chemically synthesized
aggugagguaccagccuua

SEQ ID NO: 1371 - RNA, 19 nt, Artificial Sequence
  Chemically synthesized
ccacacugggaugagaaaa

SEQ ID NO: 1372 - RNA, 19 nt, Artificial Sequence
  Chemically synthesized
gccauugacaagaacaaga

SEQ ID NO: 1373 - RNA, 19 nt, Artificial Sequence
  Chemically synthesized
gcgcugcaguccaucaaca

SEQ ID NO: 1374 - RNA, 19 nt, Artificial Sequence
  Chemically synthesized
cucccaacuauaaaacuaa

SEQ ID NO: 1375 - RNA, 19 nt, Artificial Sequence
  Chemically synthesized
ggugacaagaugcgagaca

SEQ ID NO: 1376 - RNA, 19 nt, Artificial Sequence
  Chemically synthesized
ggccgacuugucacgcaua

SEQ ID NO: 1377 - RNA, 19 nt, Artificial Sequence
  Chemically synthesized
ccuaagggugacaagauga

SEQ ID NO: 1378 - RNA, 19 nt, Artificial Sequence
  Chemically synthesized
ugagacacaugggugcuaa

SEQ ID NO: 1379 - RNA, 19 nt, Artificial Sequence
  Chemically synthesized
ggguggaaaaacagaccga

SEQ ID NO: 1380 - RNA, 19 nt, Artificial Sequence
  Chemically synthesized
gguggaggugacccaugaa

SEQ ID NO: 1381 - RNA, 19 nt, Artificial Sequence
  Chemically synthesized
cuuugaccaggacaucuaa

SEQ ID NO: 1382 - RNA, 19 nt, Artificial Sequence
  Chemically synthesized
gaacaugagccuuuguuga

SEQ ID NO: 1383 - RNA, 19 nt, Artificial Sequence
  Chemically synthesized
agccuuggauacuccauga

SEQ ID NO: 1384 - RNA, 19 nt, Artificial Sequence
  Chemically synthesized
ggaggugacccaugaccua

SEQ ID NO: 1385 - RNA, 19 nt, Artificial Sequence
  Chemically synthesized
agaucaagccugccucaaa

SEQ ID NO: 1386 - RNA, 19 nt, Artificial Sequence
  Chemically synthesized
gcccaagggugugguggaa

SEQ ID NO: 1387 - RNA, 19 nt, Artificial Sequence
  Chemically synthesized
agaacaaggccgacuugua

SEQ ID NO: 1388 - RNA, 19 nt, Artificial Sequence
  Chemically synthesized
guggcuucauggugacuca

SEQ ID NO: 1389 - RNA, 19 nt, Artificial Sequence
  Chemically synthesized
cuccugagacacaugggua

SEQ ID NO: 1390 - RNA, 19 nt, Artificial Sequence
  Chemically synthesized
cagccuuggauacuccaua

SEQ ID NO: 1391 - RNA, 19 nt, Artificial Sequence
  Chemically synthesized
aaggcuccugagacacaua

SEQ ID NO: 1392 - RNA, 19 nt, Artificial Sequence
  Chemically synthesized
agaagaaggcuguugccaa

SEQ ID NO: 1393 - RNA, 19 nt, Artificial Sequence
  Chemically synthesized
cuacuacgacgacgagaaa

SEQ ID NO: 1394 - RNA, 19 nt, Artificial Sequence
  Chemically synthesized
ccuuuguugcuaucaauca

SEQ ID NO: 1395 - RNA, 19 nt, Artificial Sequence
  Chemically synthesized
aggcaguggagaacaucca

SEQ ID NO: 1396 - RNA, 19 nt, Artificial Sequence
  Chemically synthesized
ccaucacguggagccucua

SEQ ID NO: 1397 - RNA, 19 nt, Artificial Sequence
  Chemically synthesized
agcucuccagccucaucaa

SEQ ID NO: 1398 - RNA, 19 nt, Artificial Sequence
  Chemically synthesized
ggcucccugcuauucauua

SEQ ID NO: 1399 - RNA, 19 nt, Artificial Sequence
  Chemically synthesized
gggaacaugagccuuugua

SEQ ID NO: 1400 - RNA, 19 nt, Artificial Sequence
  Chemically synthesized
gggccauagucauucugca

SEQ ID NO: 1401 - RNA, 19 nt, Artificial Sequence
  Chemically synthesized
ccaaagagcagcugaagaa

SEQ ID NO: 1402 - RNA, 19 nt, Artificial Sequence
  Chemically synthesized
gacgagaaggaaaagcuga

SEQ ID NO: 1403 - RNA, 19 nt, Artificial Sequence
  Chemically synthesized
gggcuucugggcagacuca

SEQ ID NO: 1404 - RNA, 19 nt, Artificial Sequence
  Chemically synthesized
caaggaccaggcaguggaa

SEQ ID NO: 1405 - RNA, 19 nt, Artificial Sequence
  Chemically synthesized
cugugagaccaaauugaga

SEQ ID NO: 1406 - RNA, 19 nt, Artificial Sequence
  Chemically synthesized
gacugaggccauugacaaa

SEQ ID NO: 1407 - RNA, 19 nt, Artificial Sequence
  Chemically synthesized
gacuugucacgcaugucaa

SEQ ID NO: 1408 - RNA, 19 nt, Artificial Sequence
  Chemically synthesized
gaggugagguaccagccua

SEQ ID NO: 1409 - RNA, 19 nt, Artificial Sequence
  Chemically synthesized
cagauaccaugaugcugaa

SEQ ID NO: 1410 - RNA, 19 nt, Artificial Sequence
  Chemically synthesized
aggcaagaaggaccuguaa

SEQ ID NO: 1411 - RNA, 19 nt, Artificial Sequence
  Chemically synthesized
cugggaugagaaauuccaa

SEQ ID NO: 1412 - RNA, 19 nt, Artificial Sequence
  Chemically synthesized
agguaccagccuuggauaa

SEQ ID NO: 1413 - RNA, 19 nt, Artificial Sequence
  Chemically synthesized
cagccagcccucuucugaa

SEQ ID NO: 1414 - RNA, 19 nt, Artificial Sequence
  Chemically synthesized
gugucaugaugaugcacca

SEQ ID NO: 1415 - RNA, 19 nt, Artificial Sequence
  Chemically synthesized
ccucuacaacuacuacgaa

SEQ ID NO: 1416 - RNA, 19 nt, Artificial Sequence
  Chemically synthesized
ccgccgaggugaagaaaca

SEQ ID NO: 1417 - RNA, 19 nt, Artificial Sequence
  Chemically synthesized
gcuaucaauccaagaacua

SEQ ID NO: 1418 - RNA, 19 nt, Artificial Sequence
  Chemically synthesized
agccugccucaaucaguaa

SEQ ID NO: 1419 - RNA, 19 nt, Artificial Sequence
  Chemically synthesized
gguccggccuaagggugaa

SEQ ID NO: 1420 - RNA, 19 nt, Artificial Sequence
  Chemically synthesized
gaaggaaaagcugcaaaua

SEQ ID NO: 1421 - RNA, 19 nt, Artificial Sequence
  Chemically synthesized
ggccucuacaacuacuaca

SEQ ID NO: 1422 - RNA, 19 nt, Artificial Sequence
  Chemically synthesized
uguucuucaagccacacua

SEQ ID NO: 1423 - RNA, 19 nt, Artificial Sequence
  Chemically synthesized
ggccaaggcagugcugaga

SEQ ID NO: 1424 - RNA, 19 nt, Artificial Sequence
  Chemically synthesized
agaaauuccaccacaagaa

SEQ ID NO: 1425 - RNA, 19 nt, Artificial Sequence
  Chemically synthesized
cugcaguccaucaacgaga

SEQ ID NO: 1426 - RNA, 19 nt, Artificial Sequence
  Chemically synthesized
ccagcguguuccacgccaa

SEQ ID NO: 1427 - RNA, 19 nt, Artificial Sequence
  Chemically synthesized
gcucccuccugcuucucaa

SEQ ID NO: 1428 - RNA, 19 nt, Artificial Sequence
  Chemically synthesized
ccggacaggccucuacaaa

SEQ ID NO: 1429 - RNA, 19 nt, Artificial Sequence
  Chemically synthesized
cccaucacguggagccuca

SEQ ID NO: 1430 - RNA, 19 nt, Artificial Sequence
  Chemically synthesized
ccggccuaagggugacaaa

SEQ ID NO: 1431 - RNA, 19 nt, Artificial Sequence
  Chemically synthesized
ccuauaccgugggugucaa

SEQ ID NO: 1432 - RNA, 19 nt, Artificial Sequence
  Chemically synthesized
caguggagaacauccugga

SEQ ID NO: 1433 - RNA, 19 nt, Artificial Sequence
  Chemically synthesized
cacugggaugagaaauuca

SEQ ID NO: 1434 - RNA, 19 nt, Artificial Sequence
  Chemically synthesized
auccaaaggcuccugagaa

SEQ ID NO: 1435 - RNA, 19 nt, Artificial Sequence
  Chemically synthesized
ugagaaauuccaccacaaa

SEQ ID NO: 1436 - RNA, 19 nt, Artificial Sequence
  Chemically synthesized
gguggaaaaacagaccgga

SEQ ID NO: 1437 - RNA, 19 nt, Artificial Sequence
  Chemically synthesized
gcugggcagccgacuguaa

SEQ ID NO: 1438 - RNA, 19 nt, Artificial Sequence
  Chemically synthesized
ccauagucauucugccuga

SEQ ID NO: 1439 - RNA, 19 nt, Artificial Sequence
  Chemically synthesized
gcaccggacaggccucuaa

SEQ ID NO: 1440 - RNA, 19 nt, Artificial Sequence
  Chemically synthesized
guuggacacagauggcaaa

SEQ ID NO: 1441 - RNA, 19 nt, Artificial Sequence
  Chemically synthesized
gccugccucaaucaguaua

SEQ ID NO: 1442 - RNA, 19 nt, Artificial Sequence
  Chemically synthesized
gaucaacuuccgcgacaaa

SEQ ID NO: 1443 - RNA, 19 nt, Artificial Sequence
  Chemically synthesized
ggccgcagugaggcggaua

SEQ ID NO: 1444 - RNA, 19 nt, Artificial Sequence
  Chemically synthesized
cugcggagaaguugagcca

SEQ ID NO: 1445 - RNA, 19 nt, Artificial Sequence
  Chemically synthesized
gcauccaaaggcuccugaa

SEQ ID NO: 1446 - RNA, 19 nt, Artificial Sequence
  Chemically synthesized
gcuucugggcagacucuga

SEQ ID NO: 1447 - RNA, 19 nt, Artificial Sequence
  Chemically synthesized
ccagcccucuucugacaca

SEQ ID NO: 1448 - RNA, 19 nt, Artificial Sequence
  Chemically synthesized
gcucuaucccaaccucuca

SEQ ID NO: 1449 - RNA, 19 nt, Artificial Sequence
  Chemically synthesized
ggacguggagcgcacggaa

SEQ ID NO: 1450 - RNA, 19 nt, Artificial Sequence
  Chemically synthesized
ccaaggcagugcugagcga

SEQ ID NO: 1451 - RNA, 19 nt, Artificial Sequence
  Chemically synthesized
gcagaagaaggcuguugca

SEQ ID NO: 1452 - RNA, 19 nt, Artificial Sequence
  Chemically synthesized
gacauuuuguuggagcgua

SEQ ID NO: 1453 - RNA, 19 nt, Artificial Sequence
  Chemically synthesized
cgagcacuccaagaucaaa

SEQ ID NO: 1454 - RNA, 19 nt, Artificial Sequence
  Chemically synthesized
ucaugaugaugcaccggaa

SEQ ID NO: 1455 - RNA, 19 nt, Artificial Sequence
  Chemically synthesized
ccugcuucucagcgccuua

SEQ ID NO: 1456 - RNA, 19 nt, Artificial Sequence
  Chemically synthesized
cccaaccucucccaacuaa

SEQ ID NO: 1457 - RNA, 19 nt, Artificial Sequence
  Chemically synthesized
ugggcagacucuggucaaa

SEQ ID NO: 1458 - RNA, 19 nt, Artificial Sequence
  Chemically synthesized
cucuggucaagaagcauca

SEQ ID NO: 1459 - RNA, 19 nt, Artificial Sequence
  Chemically synthesized
gagccucucgagcgccuua

SEQ ID NO: 1460 - RNA, 19 nt, Artificial Sequence
  Chemically synthesized
agaaggcuguugccaucua

SEQ ID NO: 1461 - RNA, 19 nt, Artificial Sequence
  Chemically synthesized
cccugcuagucaacgccaa

SEQ ID NO: 1462 - RNA, 19 nt, Artificial Sequence
  Chemically synthesized
gccuucagcuuguaccaga

SEQ ID NO: 1463 - RNA, 19 nt, Artificial Sequence
  Chemically synthesized
gcugcuaaccaaagagcaa

SEQ ID NO: 1464 - RNA, 19 nt, Artificial Sequence
  Chemically synthesized
cccacaagcucuccagcca

SEQ ID NO: 1465 - RNA, 19 nt, Artificial Sequence
  Chemically synthesized
gcucccugcuauucauuga

SEQ ID NO: 1466 - RNA, 19 nt, Artificial Sequence
  Chemically synthesized
guucuucaaagauagggaa

SEQ ID NO: 1467 - RNA, 19 nt, Artificial Sequence
  Chemically synthesized
gucagccagcccucuucua

SEQ ID NO: 1468 - RNA, 19 nt, Artificial Sequence
  Chemically synthesized
gcgggacacccaaagcgga

SEQ ID NO: 1469 - RNA, 19 nt, Artificial Sequence
  Chemically synthesized
agcgcagcgcgcugcagua

SEQ ID NO: 1470 - RNA, 19 nt, Artificial Sequence
  Chemically synthesized
ccggaaacuccacauccua

SEQ ID NO: 1471 - RNA, 19 nt, Artificial Sequence
  Chemically synthesized
ccauugacaagaacaagga

SEQ ID NO: 1472 - RNA, 19 nt, Artificial Sequence
  Chemically synthesized
ggacaucuacgggcgcgaa

SEQ ID NO: 1473 - RNA, 19 nt, Artificial Sequence
  Chemically synthesized
gacacaugggugcuauuga

SEQ ID NO: 1474 - RNA, 19 nt, Artificial Sequence
  Chemically synthesized
ccuggcacugcggagaaga

SEQ ID NO: 1475 - RNA, 19 nt, Artificial Sequence
  Chemically synthesized
gggccugacugaggccaua

SEQ ID NO: 1476 - RNA, 19 nt, Artificial Sequence
  Chemically synthesized
acacugggaugagaaauua

SEQ ID NO: 1477 - RNA, 19 nt, Artificial Sequence
  Chemically synthesized
ggucagccagcccucuuca

SEQ ID NO: 1478 - RNA, 19 nt, Artificial Sequence
  Chemically synthesized
gugaggcggauugagaaga

SEQ ID NO: 1479 - RNA, 19 nt, Artificial Sequence
  Chemically synthesized
ucaccugugagaccaaaua

SEQ ID NO: 1480 - RNA, 19 nt, Artificial Sequence
  Chemically synthesized
agcugcaaaucguggagaa

SEQ ID NO: 1481 - RNA, 19 nt, Artificial Sequence
  Chemically synthesized
ggugcacacaggauggcaa

SEQ ID NO: 1482 - RNA, 19 nt, Artificial Sequence
  Chemically synthesized
gggugugguggaggugaca

SEQ ID NO: 1483 - RNA, 19 nt, Artificial Sequence
  Chemically synthesized
ccagccuuggauacuccaa

SEQ ID NO: 1484 - RNA, 19 nt, Artificial Sequence
  Chemically synthesized
ccacaagcucuccagccua

SEQ ID NO: 1485 - RNA, 19 nt, Artificial Sequence
  Chemically synthesized
aaaggcuccugagacacaa

SEQ ID NO: 1486 - RNA, 19 nt, Artificial Sequence
  Chemically synthesized
aggaaaagcugcaaaucga

SEQ ID NO: 1487 - RNA, 19 nt, Artificial Sequence
  Chemically synthesized
cgcagcagcuccuggcaca

SEQ ID NO: 1488 - RNA, 19 nt, Artificial Sequence
  Chemically synthesized
ggugucaugaugaugcaca

SEQ ID NO: 1489 - RNA, 19 nt, Artificial Sequence
  Chemically synthesized
ccucuucugacacuaaaaa

SEQ ID NO: 1490 - RNA, 19 nt, Artificial Sequence
  Chemically synthesized
agcuagaauucacuccaca

SEQ ID NO: 1491 - RNA, 19 nt, Artificial Sequence
  Chemically synthesized
cgcugggcggcaaggcgaa

SEQ ID NO: 1492 - RNA, 19 nt, Artificial Sequence
  Chemically synthesized
ggccuggccuucagcuuga

SEQ ID NO: 1493 - RNA, 19 nt, Artificial Sequence
  Chemically synthesized
agacacaugggugcuauua

SEQ ID NO: 1494 - RNA, 19 nt, Artificial Sequence
  Chemically synthesized
cgugggugucaugaugaua

SEQ ID NO: 1495 - RNA, 19 nt, Artificial Sequence
  Chemically synthesized
gugggugucaugaugauga

SEQ ID NO: 1496 - RNA, 19 nt, Artificial Sequence
  Chemically synthesized
gagaaggagcucccaggaa

SEQ ID NO: 1497 - RNA, 19 nt, Artificial Sequence
  Chemically synthesized
gacucuggucaagaagcaa

SEQ ID NO: 1498 - RNA, 19 nt, Artificial Sequence
  Chemically synthesized
cacuaaaacaccucagcua

SEQ ID NO: 1499 - RNA, 19 nt, Artificial Sequence
  Chemically synthesized
ggaggcauccaaaggcuca

SEQ ID NO: 1500 - RNA, 19 nt, Artificial Sequence
  Chemically synthesized
gacccagcucagugagcua

SEQ ID NO: 1501 - RNA, 19 nt, Artificial Sequence
  Chemically synthesized
ccaugaccugcagaaacaa

SEQ ID NO: 1502 - RNA, 19 nt, Artificial Sequence
  Chemically synthesized
agaugcagaagaaggcuga

SEQ ID NO: 1503 - RNA, 19 nt, Artificial Sequence
  Chemically synthesized
cagcaagcagcacuacaaa

SEQ ID NO: 1504 - RNA, 19 nt, Artificial Sequence
  Chemically synthesized
caagcucuccagccucaua

SEQ ID NO: 1505 - RNA, 19 nt, Artificial Sequence
  Chemically synthesized
ugcagaagaaggcuguuga

SEQ ID NO: 1506 - RNA, 19 nt, Artificial Sequence
  Chemically synthesized
ggcgcgaggagcugcgcaa

SEQ ID NO: 1507 - RNA, 19 nt, Artificial Sequence
  Chemically synthesized
gguaccagccuuggauaca

SEQ ID NO: 1508 - RNA, 19 nt, Artificial Sequence
  Chemically synthesized
gcagccgacuguacggaca

SEQ ID NO: 1509 - RNA, 19 nt, Artificial Sequence
  Chemically synthesized
cagccucaucauccucaua

SEQ ID NO: 1510 - RNA, 19 nt, Artificial Sequence
  Chemically synthesized
gccaccgccuuugaguuga

SEQ ID NO: 1511 - RNA, 19 nt, Artificial Sequence
  Chemically synthesized
agaaggaccuguaccugga

SEQ ID NO: 1512 - RNA, 19 nt, Artificial Sequence
  Chemically synthesized
ggugaagaaaccugcagca

SEQ ID NO: 1513 - RNA, 19 nt, Artificial Sequence
  Chemically synthesized
guaccuucucaccugugaa

SEQ ID NO: 1514 - RNA, 19 nt, Artificial Sequence
  Chemically synthesized
ggccaaggaccaggcagua

SEQ ID NO: 1515 - RNA, 19 nt, Artificial Sequence
  Chemically synthesized
ggcggcaaggcgaccacga

SEQ ID NO: 1516 - RNA, 19 nt, Artificial Sequence
  Chemically synthesized
agcacuccaagaucaacua

SEQ ID NO: 1517 - RNA, 19 nt, Artificial Sequence
  Chemically synthesized
auauuuauagccagguaca

SEQ ID NO: 1518 - RNA, 19 nt, Artificial Sequence
  Chemically synthesized
ggcagccgacuguacggaa

SEQ ID NO: 1519 - RNA, 19 nt, Artificial Sequence
  Chemically synthesized
gucacgcaugucaggcaaa

SEQ ID NO: 1520 - RNA, 19 nt, Artificial Sequence
  Chemically synthesized
gacaggccucuacaacuaa

SEQ ID NO: 1521 - RNA, 19 nt, Artificial Sequence
  Chemically synthesized
gaugcagaagaaggcugua

SEQ ID NO: 1522 - RNA, 19 nt, Artificial Sequence
  Chemically synthesized
acccaugaccugcagaaaa

SEQ ID NO: 1523 - RNA, 19 nt, Artificial Sequence
  Chemically synthesized
ggcuucauggugacucgga

SEQ ID NO: 1524 - RNA, 19 nt, Artificial Sequence
  Chemically synthesized
ugccucaaucaguauucaa

SEQ ID NO: 1525 - RNA, 19 nt, Artificial Sequence
  Chemically synthesized
guucuucaagccacacuga

SEQ ID NO: 1526 - RNA, 19 nt, Artificial Sequence
  Chemically synthesized
acuccaagaucaacuucca

SEQ ID NO: 1527 - RNA, 19 nt, Artificial Sequence
  Chemically synthesized
gcuguucuacgccgaccaa

SEQ ID NO: 1528 - RNA, 19 nt, Artificial Sequence
  Chemically synthesized
uagucaacgccauguucua

SEQ ID NO: 1529 - RNA, 19 nt, Artificial Sequence
  Chemically synthesized
ccgugugccugagcggaca

SEQ ID NO: 1530 - RNA, 19 nt, Artificial Sequence
  Chemically synthesized
aggccucuacaacuacuaa

SEQ ID NO: 1531 - RNA, 19 nt, Artificial Sequence
  Chemically synthesized
gcuucauggugacucggua

SEQ ID NO: 1532 - RNA, 19 nt, Artificial Sequence
  Chemically synthesized
ggucaagaagcaucgugua

SEQ ID NO: 1533 - RNA, 19 nt, Artificial Sequence
  Chemically synthesized
cugcgagcacuccaagaua

SEQ ID NO: 1534 - RNA, 19 nt, Artificial Sequence
  Chemically synthesized
guccuauaccgugggugua

SEQ ID NO: 1535 - RNA, 19 nt, Artificial Sequence
  Chemically synthesized
ggccugacugaggccauua

SEQ ID NO: 1536 - RNA, 19 nt, Artificial Sequence
  Chemically synthesized
cacuccaagaucaacuuca

SEQ ID NO: 1537 - RNA, 19 nt, Artificial Sequence
  Chemically synthesized
gcgucgcaggccaaggcaa

SEQ ID NO: 1538 - RNA, 19 nt, Artificial Sequence
  Chemically synthesized
aagggugacaagaugcgaa

SEQ ID NO: 1539 - RNA, 19 nt, Artificial Sequence
  Chemically synthesized
caagcuguucuacgccgaa

SEQ ID NO: 1540 - RNA, 19 nt, Artificial Sequence
  Chemically synthesized
ccugcuagucaacgccaua

SEQ ID NO: 1541 - RNA, 19 nt, Artificial Sequence
  Chemically synthesized
ccaagggugugguggagga

SEQ ID NO: 1542 - RNA, 19 nt, Artificial Sequence
  Chemically synthesized
cacacaggauggcaggaga

SEQ ID NO: 1543 - RNA, 19 nt, Artificial Sequence
  Chemically synthesized
uccugagacacauggguga

SEQ ID NO: 1544 - RNA, 19 nt, Artificial Sequence
  Chemically synthesized
cuacaacuacuacgacgaa

SEQ ID NO: 1545 - RNA, 19 nt, Artificial Sequence
  Chemically synthesized
gacaagaugcgagacgaga

SEQ ID NO: 1546 - RNA, 19 nt, Artificial Sequence
  Chemically synthesized
ccuggaagcugggcagcca

SEQ ID NO: 1547 - RNA, 19 nt, Artificial Sequence
  Chemically synthesized
cuucaagccacacugggaa

SEQ ID NO: 1548 - RNA, 19 nt, Artificial Sequence
  Chemically synthesized
gcgagacgaguuauaggga

SEQ ID NO: 1549 - RNA, 19 nt, Artificial Sequence
  Chemically synthesized
gaagcugggcagccgacua

SEQ ID NO: 1550 - RNA, 19 nt, Artificial Sequence
  Chemically synthesized
gugccugagcggaccuuca

SEQ ID NO: 1551 - RNA, 19 nt, Artificial Sequence
  Chemically synthesized
ggugacccaugaccugcaa

SEQ ID NO: 1552 - RNA, 19 nt, Artificial Sequence
  Chemically synthesized
augagccuuuguugcuaua

SEQ ID NO: 1553 - RNA, 19 nt, Artificial Sequence
  Chemically synthesized
caacuacuacgacgacgaa

SEQ ID NO: 1554 - RNA, 19 nt, Artificial Sequence
  Chemically synthesized
gcugcgcucacucagcaaa

SEQ ID NO: 1555 - RNA, 19 nt, Artificial Sequence
  Chemically synthesized
gagaacauccuggugucaa

SEQ ID NO: 1556 - RNA, 19 nt, Artificial Sequence
  Chemically synthesized
cccaagcuguucuacgcca

SEQ ID NO: 1557 - RNA, 19 nt, Artificial Sequence
  Chemically synthesized
cagcucuaucccaaccuca

SEQ ID NO: 1558 - RNA, 19 nt, Artificial Sequence
  Chemically synthesized
ugagcuucgcugaugacua

SEQ ID NO: 1559 - RNA, 19 nt, Artificial Sequence
  Chemically synthesized
cccaaggcggccacgcuua

SEQ ID NO: 1560 - RNA, 19 nt, Artificial Sequence
  Chemically synthesized
cuauaccgugggugucaua

SEQ ID NO: 1561 - RNA, 19 nt, Artificial Sequence
  Chemically synthesized
cauugacaagaacaaggca

SEQ ID NO: 1562 - RNA, 19 nt, Artificial Sequence
  Chemically synthesized
ggacccagcucagugagca

SEQ ID NO: 1563 - RNA, 19 nt, Artificial Sequence
  Chemically synthesized
gacgacgagaaggaaaaga

SEQ ID NO: 1564 - RNA, 19 nt, Artificial Sequence
  Chemically synthesized
gcggcaaggcgaccacgga

SEQ ID NO: 1565 - RNA, 19 nt, Artificial Sequence
  Chemically synthesized
gggacacccaaagcggcua

SEQ ID NO: 1566 - RNA, 19 nt, Artificial Sequence
  Chemically synthesized
gggaggugagguaccagca

SEQ ID NO: 1567 - RNA, 19 nt, Artificial Sequence
  Chemically synthesized
gcagcacuacaacugcgaa

SEQ ID NO: 1568 - RNA, 19 nt, Artificial Sequence
  Chemically synthesized
gcgcaacgugaccuggaaa

SEQ ID NO: 1569 - RNA, 19 nt, Artificial Sequence
  Chemically synthesized
gggcugggccugacugaga

SEQ ID NO: 1570 - RNA, 19 nt, Artificial Sequence
  Chemically synthesized
ccugagcggaccuucccaa

SEQ ID NO: 1571 - RNA, 19 nt, Artificial Sequence
  Chemically synthesized
gcagcugaagaucuggaua

SEQ ID NO: 1572 - RNA, 19 nt, Artificial Sequence
  Chemically synthesized
aguggagaacauccuggua

SEQ ID NO: 1573 - RNA, 19 nt, Artificial Sequence
  Chemically synthesized
gcaagcagcacuacaacua

SEQ ID NO: 1574 - RNA, 19 nt, Artificial Sequence
  Chemically synthesized
agcucagugagcuucgcua

SEQ ID NO: 1575 - RNA, 19 nt, Artificial Sequence
  Chemically synthesized
ccgacuugucacgcaugua

SEQ ID NO: 1576 - RNA, 19 nt, Artificial Sequence
  Chemically synthesized
ccgaggucaccaaggacga

SEQ ID NO: 1577 - RNA, 19 nt, Artificial Sequence
  Chemically synthesized
ggagccucucgagcgccua

SEQ ID NO: 1578 - RNA, 19 nt, Artificial Sequence
  Chemically synthesized
ggccgcgcagaccaccgaa

SEQ ID NO: 1579 - RNA, 19 nt, Artificial Sequence
  Chemically synthesized
ggaaacuccacauccugua

SEQ ID NO: 1580 - RNA, 19 nt, Artificial Sequence
  Chemically synthesized
caaagcggcucccugcuaa

SEQ ID NO: 1581 - RNA, 19 nt, Artificial Sequence
  Chemically synthesized
gcuccugagacacauggga

SEQ ID NO: 1582 - RNA, 19 nt, Artificial Sequence
  Chemically synthesized
ccugggccauagucauuca

SEQ ID NO: 1583 - RNA, 19 nt, Artificial Sequence
  Chemically synthesized
cguggagccucucgagcga

SEQ ID NO: 1584 - RNA, 19 nt, Artificial Sequence
  Chemically synthesized
ccuccugcuucucagcgca

SEQ ID NO: 1585 - RNA, 19 nt, Artificial Sequence
  Chemically synthesized
agucccagaucaagccuga

SEQ ID NO: 1586 - RNA, 19 nt, Artificial Sequence
  Chemically synthesized
uaccgugggugucaugaua

SEQ ID NO: 1587 - RNA, 19 nt, Artificial Sequence
  Chemically synthesized
gccagcccucuucugacaa

SEQ ID NO: 1588 - RNA, 19 nt, Artificial Sequence
  Chemically synthesized
ccgaggugaagaaaccuga

SEQ ID NO: 1589 - RNA, 19 nt, Artificial Sequence
  Chemically synthesized
uccuggcacugcggagaaa

SEQ ID NO: 1590 - RNA, 19 nt, Artificial Sequence
  Chemically synthesized
cccggaaacuccacaucca

SEQ ID NO: 1591 - RNA, 19 nt, Artificial Sequence
  Chemically synthesized
acucuggucaagaagcaua

SEQ ID NO: 1592 - RNA, 19 nt, Artificial Sequence
  Chemically synthesized
cccagauaccaugaugcua

SEQ ID NO: 1593 - RNA, 19 nt, Artificial Sequence
  Chemically synthesized
ccugagacacaugggugca

SEQ ID NO: 1594 - RNA, 19 nt, Artificial Sequence
  Chemically synthesized
gcacuacaacugcgagcaa

SEQ ID NO: 1595 - RNA, 19 nt, Artificial Sequence
  Chemically synthesized
ccacaagaugguggacaaa

SEQ ID NO: 1596 - RNA, 19 nt, Artificial Sequence
  Chemically synthesized
ggacacagauggcaaccca

SEQ ID NO: 1597 - RNA, 19 nt, Artificial Sequence
  Chemically synthesized
gaaaagcugcuaaccaaaa

SEQ ID NO: 1598 - RNA, 19 nt, Artificial Sequence
  Chemically synthesized
acuacaacugcgagcacua

SEQ ID NO: 1599 - RNA, 19 nt, Artificial Sequence
  Chemically synthesized
gcacuccaagaucaacuua

SEQ ID NO: 1600 - RNA, 19 nt, Artificial Sequence
  Chemically synthesized
gccuugaaaagcugcuaaa

SEQ ID NO: 1601 - RNA, 19 nt, Artificial Sequence
  Chemically synthesized
gugacucgguccuauacca

SEQ ID NO: 1602 - RNA, 19 nt, Artificial Sequence
  Chemically synthesized
gugguggaggugacccaua

SEQ ID NO: 1603 - RNA, 19 nt, Artificial Sequence
  Chemically synthesized
augcgagacgaguuauaga

SEQ ID NO: 1604 - RNA, 19 nt, Artificial Sequence
  Chemically synthesized
accuucccagcuagaauua

SEQ ID NO: 1605 - RNA, 19 nt, Artificial Sequence
  Chemically synthesized
cccagcuagaauucacuca

SEQ ID NO: 1606 - RNA, 19 nt, Artificial Sequence
  Chemically synthesized
ggucaccaaggacguggaa

SEQ ID NO: 1607 - RNA, 19 nt, Artificial Sequence
  Chemically synthesized
ggccucagggugcacacaa

SEQ ID NO: 1608 - RNA, 19 nt, Artificial Sequence
  Chemically synthesized
ugagguaccagccuuggaa

SEQ ID NO: 1609 - RNA, 19 nt, Artificial Sequence
  Chemically synthesized
cauggugacucgguccuaa

SEQ ID NO: 1610 - RNA, 19 nt, Artificial Sequence
  Chemically synthesized
ggugagguaccagccuuga

SEQ ID NO: 1611 - RNA, 19 nt, Artificial Sequence
  Chemically synthesized
gccgaggugaagaaaccua

SEQ ID NO: 1612 - RNA, 19 nt, Artificial Sequence
  Chemically synthesized
guacggacccagcucagua

SEQ ID NO: 1613 - RNA, 19 nt, Artificial Sequence
  Chemically synthesized
caagaaggaccuguaccua

SEQ ID NO: 1614 - RNA, 19 nt, Artificial Sequence
  Chemically synthesized
gagcacuccaagaucaaca

SEQ ID NO: 1615 - RNA, 19 nt, Artificial Sequence
  Chemically synthesized
cauguucuucaagccacaa

SEQ ID NO: 1616 - RNA, 19 nt, Artificial Sequence
  Chemically synthesized
cccuccugcuucucagcga

SEQ ID NO: 1617 - RNA, 19 nt, Artificial Sequence
  Chemically synthesized
augucaggcaagaaggaca

SEQ ID NO: 1618 - RNA, 19 nt, Artificial Sequence
  Chemically synthesized
caagaucaacuuccgcgaa

SEQ ID NO: 1619 - RNA, 19 nt, Artificial Sequence
  Chemically synthesized
gcguguuccacgccaccga

SEQ ID NO: 1620 - RNA, 19 nt, Artificial Sequence
  Chemically synthesized
cggacccagcucagugaga

SEQ ID NO: 1621 - RNA, 19 nt, Artificial Sequence
  Chemically synthesized
ccuucagcuuguaccagga

SEQ ID NO: 1622 - RNA, 19 nt, Artificial Sequence
  Chemically synthesized
gcucuccagccucaucaua

SEQ ID NO: 1623 - RNA, 19 nt, Artificial Sequence
  Chemically synthesized
cccuggcccacaagcucua

SEQ ID NO: 1624 - RNA, 19 nt, Artificial Sequence
  Chemically synthesized
gcccgaggucaccaaggaa

SEQ ID NO: 1625 - RNA, 19 nt, Artificial Sequence
  Chemically synthesized
guggagaacauccugguga

SEQ ID NO: 1626 - RNA, 19 nt, Artificial Sequence
  Chemically synthesized
gcucacucagcaacuccaa

SEQ ID NO: 1627 - RNA, 19 nt, Artificial Sequence
  Chemically synthesized
acgccauguucuucaagca

SEQ ID NO: 1628 - RNA, 19 nt, Artificial Sequence
  Chemically synthesized
acacaugggugcuauugga

SEQ ID NO: 1629 - RNA, 19 nt, Artificial Sequence
  Chemically synthesized
ccagcucagugagcuucga

SEQ ID NO: 1630 - RNA, 19 nt, Artificial Sequence
  Chemically synthesized
cccagcucagugagcuuca

SEQ ID NO: 1631 - RNA, 19 nt, Artificial Sequence
  Chemically synthesized
gggcggcaaggcgaccaca

SEQ ID NO: 1632 - RNA, 19 nt, Artificial Sequence
  Chemically synthesized
cagggugcacacaggauga

SEQ ID NO: 1633 - RNA, 19 nt, Artificial Sequence
  Chemically synthesized
aggugaagaaaccugcaga

SEQ ID NO: 1634 - RNA, 19 nt, Artificial Sequence
  Chemically synthesized
ccucucccaacuauaaaaa

SEQ ID NO: 1635 - RNA, 19 nt, Artificial Sequence
  Chemically synthesized
gacuguacggacccagcua

SEQ ID NO: 1636 - RNA, 19 nt, Artificial Sequence
  Chemically synthesized
gaaggagcucccaggagga

SEQ ID NO: 1637 - RNA, 19 nt, Artificial Sequence
  Chemically synthesized
acgcaugucaggcaagaaa

SEQ ID NO: 1638 - RNA, 19 nt, Artificial Sequence
  Chemically synthesized
gacucgguccuauaccgua

SEQ ID NO: 1639 - RNA, 19 nt, Artificial Sequence
  Chemically synthesized
cacuacaacugcgagcaca

SEQ ID NO: 1640 - RNA, 19 nt, Artificial Sequence
  Chemically synthesized
agcuccuggcacugcggaa

SEQ ID NO: 1641 - RNA, 19 nt, Artificial Sequence
  Chemically synthesized
cuaagggugacaagaugca

SEQ ID NO: 1642 - RNA, 19 nt, Artificial Sequence
  Chemically synthesized
ugugagaccaaauugagca

SEQ ID NO: 1643 - RNA, 19 nt, Artificial Sequence
  Chemically synthesized
gccgacuugucacgcauga

SEQ ID NO: 1644 - RNA, 19 nt, Artificial Sequence
  Chemically synthesized
caggauggcaggaggcaua

SEQ ID NO: 1645 - RNA, 19 nt, Artificial Sequence
  Chemically synthesized
acaagaacaaggccgacua

SEQ ID NO: 1646 - RNA, 19 nt, Artificial Sequence
  Chemically synthesized
ugcgcucccuccugcuuca

SEQ ID NO: 1647 - RNA, 19 nt, Artificial Sequence
  Chemically synthesized
ggcgagcugcugcgcucaa

SEQ ID NO: 1648 - RNA, 19 nt, Artificial Sequence
  Chemically synthesized
gaugcaccggacaggccua

SEQ ID NO: 1649 - RNA, 19 nt, Artificial Sequence
  Chemically synthesized
cgugucgcugggcggcaaa

SEQ ID NO: 1650 - RNA, 19 nt, Artificial Sequence
  Chemically synthesized
aucccaaccucucccaaca

SEQ ID NO: 1651 - RNA, 19 nt, Artificial Sequence
  Chemically synthesized
uguucuacgccgaccacca

SEQ ID NO: 1652 - RNA, 19 nt, Artificial Sequence
  Chemically synthesized
cggccuggccuucagcuua

SEQ ID NO: 1653 - RNA, 19 nt, Artificial Sequence
  Chemically synthesized
gucgcaggccaaggcagua

SEQ ID NO: 1654 - RNA, 19 nt, Artificial Sequence
  Chemically synthesized
agucauucugccugcccua

SEQ ID NO: 1655 - RNA, 19 nt, Artificial Sequence
  Chemically synthesized
cccagaaugaccuggccga

SEQ ID NO: 1656 - RNA, 19 nt, Artificial Sequence
  Chemically synthesized
acaagaugguggacaacca

SEQ ID NO: 1657 - RNA, 19 nt, Artificial Sequence
  Chemically synthesized
gcuagucaacgccauguua

SEQ ID NO: 1658 - RNA, 19 nt, Artificial Sequence
  Chemically synthesized
acgccaccgccuuugagua

SEQ ID NO: 1659 - RNA, 19 nt, Artificial Sequence
  Chemically synthesized
gccgcgcagaccaccgaca

SEQ ID NO: 1660 - RNA, 19 nt, Artificial Sequence
  Chemically synthesized
gcuauucauugggcgccua

SEQ ID NO: 1661 - RNA, 19 nt, Artificial Sequence
  Chemically synthesized
cucagugagcuucgcugaa

SEQ ID NO: 1662 - RNA, 19 nt, Artificial Sequence
  Chemically synthesized
ggaggugagguaccagcca

SEQ ID NO: 1663 - RNA, 19 nt, Artificial Sequence
  Chemically synthesized
gccaaggcagugcugagca

SEQ ID NO: 1664 - RNA, 19 nt, Artificial Sequence
  Chemically synthesized
cucuccagccucaucauca

SEQ ID NO: 1665 - RNA, 19 nt, Artificial Sequence
  Chemically synthesized
gaaugaccuggccgcagua

SEQ ID NO: 1666 - RNA, 19 nt, Artificial Sequence
  Chemically synthesized
uggugacucgguccuauaa

SEQ ID NO: 1667 - RNA, 19 nt, Artificial Sequence
  Chemically synthesized
cagguaccuucucaccuga

SEQ ID NO: 1668 - RNA, 19 nt, Artificial Sequence
  Chemically synthesized
guuccacgccaccgccuua

SEQ ID NO: 1669 - RNA, 19 nt, Artificial Sequence
  Chemically synthesized
ccgacuguacggacccaga

SEQ ID NO: 1670 - RNA, 19 nt, Artificial Sequence
  Chemically synthesized
gcagaccaccgacggcaaa

SEQ ID NO: 1671 - RNA, 19 nt, Artificial Sequence
  Chemically synthesized
aagaugcgagacgaguuaa

SEQ ID NO: 1672 - RNA, 19 nt, Artificial Sequence
  Chemically synthesized
caaagagcagcugaagaua

SEQ ID NO: 1673 - RNA, 19 nt, Artificial Sequence
  Chemically synthesized
acgacgagaaggaaaagca

SEQ ID NO: 1674 - RNA, 19 nt, Artificial Sequence
  Chemically synthesized
cacuccacuuggacaugga

SEQ ID NO: 1675 - RNA, 19 nt, Artificial Sequence
  Chemically synthesized
aguccaucaacgaguggga

SEQ ID NO: 1676 - RNA, 19 nt, Artificial Sequence
  Chemically synthesized
gcgccggccuggccuucaa

SEQ ID NO: 1677 - RNA, 19 nt, Artificial Sequence
  Chemically synthesized
ggaaaagcugcaaaucgua

SEQ ID NO: 1678 - RNA, 19 nt, Artificial Sequence
  Chemically synthesized
acauuuuguuggagcguga

SEQ ID NO: 1679 - RNA, 19 nt, Artificial Sequence
  Chemically synthesized
accguggcuucauggugaa

SEQ ID NO: 1680 - RNA, 19 nt, Artificial Sequence
  Chemically synthesized
cccuucaucuuccuaguga

SEQ ID NO: 1681 - RNA, 19 nt, Artificial Sequence
  Chemically synthesized
gaaauuccaccacaagaua

SEQ ID NO: 1682 - RNA, 19 nt, Artificial Sequence
  Chemically synthesized
cuauaaaacuaggugcuga

SEQ ID NO: 1683 - RNA, 19 nt, Artificial Sequence
  Chemically synthesized
ggaggugcacgccggccua

SEQ ID NO: 1684 - RNA, 19 nt, Artificial Sequence
  Chemically synthesized
gcaggccaaggcagugcua

SEQ ID NO: 1685 - RNA, 19 nt, Artificial Sequence
  Chemically synthesized
ugagaccaaauugagcuaa

SEQ ID NO: 1686 - RNA, 19 nt, Artificial Sequence
  Chemically synthesized
gccauagucauucugccua

SEQ ID NO: 1687 - RNA, 19 nt, Artificial Sequence
  Chemically synthesized
agcugaagaucuggaugga

SEQ ID NO: 1688 - RNA, 19 nt, Artificial Sequence
  Chemically synthesized
ccaucuccuugcccaagga

SEQ ID NO: 1689 - RNA, 19 nt, Artificial Sequence
  Chemically synthesized
cccagaucaagccugccua

SEQ ID NO: 1690 - RNA, 19 nt, Artificial Sequence
  Chemically synthesized
gcuguugccaucuccuuga

SEQ ID NO: 1691 - RNA, 19 nt, Artificial Sequence
  Chemically synthesized
cgaggucaccaaggacgua

SEQ ID NO: 1692 - RNA, 19 nt, Artificial Sequence
  Chemically synthesized
caacuauaaaacuagguga

SEQ ID NO: 1693 - RNA, 19 nt, Artificial Sequence
  Chemically synthesized
gaaggcuguugccaucuca

SEQ ID NO: 1694 - RNA, 19 nt, Artificial Sequence
  Chemically synthesized
ugcggagaaguugagccca

SEQ ID NO: 1695 - RNA, 19 nt, Artificial Sequence
  Chemically synthesized
cuccuugcccaagggugua

SEQ ID NO: 1696 - RNA, 19 nt, Artificial Sequence
  Chemically synthesized
gcccugaaagucccagaua

SEQ ID NO: 1697 - RNA, 19 nt, Artificial Sequence
  Chemically synthesized
caagggugugguggaggua

SEQ ID NO: 1698 - RNA, 19 nt, Artificial Sequence
  Chemically synthesized
aagagcagcugaagaucua

SEQ ID NO: 1699 - RNA, 19 nt, Artificial Sequence
  Chemically synthesized
gaagaugcagaagaaggca

SEQ ID NO: 1700 - RNA, 19 nt, Artificial Sequence
  Chemically synthesized
cggaaacuccacauccuga

SEQ ID NO: 1701 - RNA, 19 nt, Artificial Sequence
  Chemically synthesized
agucaacgccauguucuua

SEQ ID NO: 1702 - RNA, 19 nt, Artificial Sequence
  Chemically synthesized
cgagcgccuugaaaagcua

SEQ ID NO: 1703 - RNA, 19 nt, Artificial Sequence
  Chemically synthesized
auaccgugggugucaugaa

SEQ ID NO: 1704 - RNA, 19 nt, Artificial Sequence
  Chemically synthesized
gaccugggccauagucaua

SEQ ID NO: 1705 - RNA, 19 nt, Artificial Sequence
  Chemically synthesized
caugucaggcaagaaggaa

SEQ ID NO: 1706 - RNA, 19 nt, Artificial Sequence
  Chemically synthesized
ugcgagacgaguuauagga

SEQ ID NO: 1707 - RNA, 19 nt, Artificial Sequence
  Chemically synthesized
cgcaacgugaccuggaaga

SEQ ID NO: 1708 - RNA, 19 nt, Artificial Sequence
  Chemically synthesized
agcaagcagcacuacaaca

SEQ ID NO: 1709 - RNA, 19 nt, Artificial Sequence
  Chemically synthesized
gcugcugcgcucacucaga

SEQ ID NO: 1710 - RNA, 19 nt, Artificial Sequence
  Chemically synthesized
ugaugaugcaccggacaga

SEQ ID NO: 1711 - RNA, 19 nt, Artificial Sequence
  Chemically synthesized
uuguugcuaucaauccaaa

SEQ ID NO: 1712 - RNA, 19 nt, Artificial Sequence
  Chemically synthesized
ccuugaaaagcugcuaaca

SEQ ID NO: 1713 - RNA, 19 nt, Artificial Sequence
  Chemically synthesized
cccuuugaccaggacauca

SEQ ID NO: 1714 - RNA, 19 nt, Artificial Sequence
  Chemically synthesized
gaggugaagaaaccugcaa

SEQ ID NO: 1715 - RNA, 19 nt, Artificial Sequence
  Chemically synthesized
cccaagggugugguggaga

SEQ ID NO: 1716 - RNA, 19 nt, Artificial Sequence
  Chemically synthesized
cccugcuauucauugggca

SEQ ID NO: 1717 - RNA, 19 nt, Artificial Sequence
  Chemically synthesized
cugaaagucccagaucaaa

SEQ ID NO: 1718 - RNA, 19 nt, Artificial Sequence
  Chemically synthesized
gcugcaaaucguggagaua

SEQ ID NO: 1719 - RNA, 19 nt, Artificial Sequence
  Chemically synthesized
caagccugccucaaucaga

SEQ ID NO: 1720 - RNA, 19 nt, Artificial Sequence
  Chemically synthesized
cgagcagcugcgcgacgaa

SEQ ID NO: 1721 - RNA, 19 nt, Artificial Sequence
  Chemically synthesized
aggccgacuugucacgcaa

SEQ ID NO: 1722 - RNA, 19 nt, Artificial Sequence
  Chemically synthesized
gcagcagcuccuggcacua

SEQ ID NO: 1723 - RNA, 19 nt, Artificial Sequence
  Chemically synthesized
ggccauagucauucugcca

SEQ ID NO: 1724 - RNA, 19 nt, Artificial Sequence
  Chemically synthesized
cccgugugccugagcggaa

SEQ ID NO: 1725 - RNA, 19 nt, Artificial Sequence
  Chemically synthesized
cagcugaagaucuggauga

SEQ ID NO: 1726 - RNA, 19 nt, Artificial Sequence
  Chemically synthesized
caagccacacugggaugaa

SEQ ID NO: 1727 - RNA, 19 nt, Artificial Sequence
  Chemically synthesized
gaauucacuccacuuggaa

SEQ ID NO: 1728 - RNA, 19 nt, Artificial Sequence
  Chemically synthesized
cggcgcccugcuagucaaa

SEQ ID NO: 1729 - RNA, 19 nt, Artificial Sequence
  Chemically synthesized
uggaagcugggcagccgaa

SEQ ID NO: 1730 - RNA, 19 nt, Artificial Sequence
  Chemically synthesized
ggcaaggcgaccacggcga

SEQ ID NO: 1731 - RNA, 19 nt, Artificial Sequence
  Chemically synthesized
cacugcggagaaguugaga

SEQ ID NO: 1732 - RNA, 19 nt, Artificial Sequence
  Chemically synthesized
ggcaggaggcauccaaaga

SEQ ID NO: 1733 - RNA, 19 nt, Artificial Sequence
  Chemically synthesized
ggugacucgguccuauaca

SEQ ID NO: 1734 - RNA, 19 nt, Artificial Sequence
  Chemically synthesized
uuuauagccagguaccuua

SEQ ID NO: 1735 - RNA, 19 nt, Artificial Sequence
  Chemically synthesized
ggccauggccaaggaccaa

SEQ ID NO: 1736 - RNA, 19 nt, Artificial Sequence
  Chemically synthesized
caaagauagggagggaaga

SEQ ID NO: 1737 - RNA, 19 nt, Artificial Sequence
  Chemically synthesized
ucuucugacacuaaaacaa

SEQ ID NO: 1738 - RNA, 19 nt, Artificial Sequence
  Chemically synthesized
cuucugacacuaaaacaca

SEQ ID NO: 1739 - RNA, 19 nt, Artificial Sequence
  Chemically synthesized
ucacguggagccucucgaa

SEQ ID NO: 1740 - RNA, 19 nt, Artificial Sequence
  Chemically synthesized
caguccaucaacgagugga

SEQ ID NO: 1741 - RNA, 19 nt, Artificial Sequence
  Chemically synthesized
agaccaaauugagcuagga

SEQ ID NO: 1742 - RNA, 19 nt, Artificial Sequence
  Chemically synthesized
ggguucccgugugccugaa

SEQ ID NO: 1743 - RNA, 19 nt, Artificial Sequence
  Chemically synthesized
uugcuaucaauccaagaaa

SEQ ID NO: 1744 - RNA, 19 nt, Artificial Sequence
  Chemically synthesized
caaccguggcuucauggua

SEQ ID NO: 1745 - RNA, 19 nt, Artificial Sequence
  Chemically synthesized
cuguacggacccagcucaa

SEQ ID NO: 1746 - RNA, 19 nt, Artificial Sequence
  Chemically synthesized
cagcagcaagcagcacuaa

SEQ ID NO: 1747 - RNA, 19 nt, Artificial Sequence
  Chemically synthesized
ccugcagccgcagcagcua

SEQ ID NO: 1748 - RNA, 19 nt, Artificial Sequence
  Chemically synthesized
gacacuaaaacaccucaga

SEQ ID NO: 1749 - RNA, 19 nt, Artificial Sequence
  Chemically synthesized
caacugcgagcacuccaaa

SEQ ID NO: 1750 - RNA, 19 nt, Artificial Sequence
  Chemically synthesized
acugcggagaaguugagca

SEQ ID NO: 1751 - RNA, 19 nt, Artificial Sequence
  Chemically synthesized
gcgcccugcuagucaacga

SEQ ID NO: 1752 - RNA, 19 nt, Artificial Sequence
  Chemically synthesized
ggaagcugggcagccgaca

SEQ ID NO: 1753 - RNA, 19 nt, Artificial Sequence
  Chemically synthesized
aggcuccugagacacauga

SEQ ID NO: 1754 - RNA, 19 nt, Artificial Sequence
  Chemically synthesized
cgacaagcgcagcgcgcua

SEQ ID NO: 1755 - RNA, 19 nt, Artificial Sequence
  Chemically synthesized
ucagugagcuucgcugaua

SEQ ID NO: 1756 - RNA, 19 nt, Artificial Sequence
  Chemically synthesized
uugagaaggagcucccaga

SEQ ID NO: 1757 - RNA, 19 nt, Artificial Sequence
  Chemically synthesized
acugcgagcacuccaagaa

SEQ ID NO: 1758 - RNA, 19 nt, Artificial Sequence
  Chemically synthesized
cauccuggugucacccgua

SEQ ID NO: 1759 - RNA, 19 nt, Artificial Sequence
  Chemically synthesized
gugcgcagcagcaagcaga

SEQ ID NO: 1760 - RNA, 19 nt, Artificial Sequence
  Chemically synthesized
cacgccaccgccuuugaga

SEQ ID NO: 1761 - RNA, 19 nt, Artificial Sequence
  Chemically synthesized
ucucgagcgccuugaaaaa

SEQ ID NO: 1762 - RNA, 19 nt, Artificial Sequence
  Chemically synthesized
gcuucgcugaugacuucga

SEQ ID NO: 1763 - RNA, 19 nt, Artificial Sequence
  Chemically synthesized
ucuccuugcccaaggguga

SEQ ID NO: 1764 - RNA, 19 nt, Artificial Sequence
  Chemically synthesized
gcaguccaucaacgaguga

SEQ ID NO: 1765 - RNA, 19 nt, Artificial Sequence
  Chemically synthesized
agaugguggacaaccguga

SEQ ID NO: 1766 - RNA, 19 nt, Artificial Sequence
  Chemically synthesized
cggcucccugcuauucaua

SEQ ID NO: 1767 - RNA, 19 nt, Artificial Sequence
  Chemically synthesized
auaccaugaugcugagcca

SEQ ID NO: 1768 - RNA, 19 nt, Artificial Sequence
  Chemically synthesized
agccagguaccuucucaca

SEQ ID NO: 1769 - RNA, 19 nt, Artificial Sequence
  Chemically synthesized
gagcccggaaacuccacaa

SEQ ID NO: 1770 - RNA, 19 nt, Artificial Sequence
  Chemically synthesized
gcagcuccuggcacugcga

SEQ ID NO: 1771 - RNA, 19 nt, Artificial Sequence
  Chemically synthesized
cccgaggucaccaaggaca

SEQ ID NO: 1772 - RNA, 19 nt, Artificial Sequence
  Chemically synthesized
ccugacugaggccauugaa

SEQ ID NO: 1773 - RNA, 19 nt, Artificial Sequence
  Chemically synthesized
ugcugagcccggaaacuca

SEQ ID NO: 1774 - RNA, 19 nt, Artificial Sequence
  Chemically synthesized
gccaucuccuugcccaaga

SEQ ID NO: 1775 - RNA, 19 nt, Artificial Sequence
  Chemically synthesized
caagcagcacuacaacuga

SEQ ID NO: 1776 - RNA, 19 nt, Artificial Sequence
  Chemically synthesized
caaggcagugcugagcgca

SEQ ID NO: 1777 - RNA, 19 nt, Artificial Sequence
  Chemically synthesized
caaugacauuuuguuggaa

SEQ ID NO: 1778 - RNA, 19 nt, Artificial Sequence
  Chemically synthesized
agugagcuucgcugaugaa

SEQ ID NO: 1779 - RNA, 19 nt, Artificial Sequence
  Chemically synthesized
augaugaugcaccggacaa

SEQ ID NO: 1780 - RNA, 19 nt, Artificial Sequence
  Chemically synthesized
gaaacaccuggcugggcua

SEQ ID NO: 1781 - RNA, 19 nt, Artificial Sequence
  Chemically synthesized
ccugcuauucauugggcga

SEQ ID NO: 1782 - RNA, 19 nt, Artificial Sequence
  Chemically synthesized
cgccaccgccuuugaguua

SEQ ID NO: 1783 - RNA, 19 nt, Artificial Sequence
  Chemically synthesized
gcuucucagcgccuucuga

SEQ ID NO: 1784 - RNA, 19 nt, Artificial Sequence
  Chemically synthesized
ugaugcugagcccggaaaa

SEQ ID NO: 1785 - RNA, 19 nt, Artificial Sequence
  Chemically synthesized
ugaccuggccgcagugaga

SEQ ID NO: 1786 - RNA, 19 nt, Artificial Sequence
  Chemically synthesized
ugcagaaacaccuggcuga

SEQ ID NO: 1787 - RNA, 19 nt, Artificial Sequence
  Chemically synthesized
gcagugcugagcgccgaga

SEQ ID NO: 1788 - RNA, 19 nt, Artificial Sequence
  Chemically synthesized
cggcgcgcaacgugaccua

SEQ ID NO: 1789 - RNA, 19 nt, Artificial Sequence
  Chemically synthesized
agugcugagcgccgagcaa

SEQ ID NO: 1790 - RNA, 19 nt, Artificial Sequence
  Chemically synthesized
acaggccucuacaacuaca

SEQ ID NO: 1791 - RNA, 19 nt, Artificial Sequence
  Chemically synthesized
gcagcugcgcgacgaggaa

SEQ ID NO: 1792 - RNA, 19 nt, Artificial Sequence
  Chemically synthesized
auugagaaggagcucccaa

SEQ ID NO: 1793 - RNA, 19 nt, Artificial Sequence
  Chemically synthesized
cgcgcagaccaccgacgga

SEQ ID NO: 1794 - RNA, 19 nt, Artificial Sequence
  Chemically synthesized
ccuguaccuggccagcgua

SEQ ID NO: 1795 - RNA, 19 nt, Artificial Sequence
  Chemically synthesized
cugagcggaccuucccaga

SEQ ID NO: 1796 - RNA, 19 nt, Artificial Sequence
  Chemically synthesized
ggccuucagcuuguaccaa

SEQ ID NO: 1797 - RNA, 19 nt, Artificial Sequence
  Chemically synthesized
cacccaaagcggcucccua

SEQ ID NO: 1798 - RNA, 19 nt, Artificial Sequence
  Chemically synthesized
gccaaggaccaggcaguga

SEQ ID NO: 1799 - RNA, 19 nt, Artificial Sequence
  Chemically synthesized
cucagggugcacacaggaa

SEQ ID NO: 1800 - RNA, 19 nt, Artificial Sequence
  Chemically synthesized
cgagcugcugcgcucacua

SEQ ID NO: 1801 - RNA, 19 nt, Artificial Sequence
  Chemically synthesized
ggcugggccugacugagga

SEQ ID NO: 1802 - RNA, 19 nt, Artificial Sequence
  Chemically synthesized
ccgcagcagcuccuggcaa

SEQ ID NO: 1803 - RNA, 19 nt, Artificial Sequence
  Chemically synthesized
ugugggaccugggccauaa

SEQ ID NO: 1804 - RNA, 19 nt, Artificial Sequence
  Chemically synthesized
aagaugcagaagaaggcua

SEQ ID NO: 1805 - RNA, 19 nt, Artificial Sequence
  Chemically synthesized
ccacggcgcgcaacgugaa

SEQ ID NO: 1806 - RNA, 19 nt, Artificial Sequence
  Chemically synthesized
accuucucaccugugagaa

SEQ ID NO: 1807 - RNA, 19 nt, Artificial Sequence
  Chemically synthesized
ugaagaaaccugcagccga

SEQ ID NO: 1808 - RNA, 19 nt, Artificial Sequence
  Chemically synthesized
cagcacuacaacugcgaga

SEQ ID NO: 1809 - RNA, 19 nt, Artificial Sequence
  Chemically synthesized
gcgacaagcgcagcgcgca

SEQ ID NO: 1810 - RNA, 19 nt, Artificial Sequence
  Chemically synthesized
uagaauucacuccacuuga

SEQ ID NO: 1811 - RNA, 19 nt, Artificial Sequence
  Chemically synthesized
guggaaaaacagaccggga

SEQ ID NO: 1812 - RNA, 19 nt, Artificial Sequence
  Chemically synthesized
acguggagccucucgagca

SEQ ID NO: 1813 - RNA, 19 nt, Artificial Sequence
  Chemically synthesized
ggcgcgcaacgugaccuga

SEQ ID NO: 1814 - RNA, 19 nt, Artificial Sequence
  Chemically synthesized
uggacaaccguggcuucaa

SEQ ID NO: 1815 - RNA, 19 nt, Artificial Sequence
  Chemically synthesized
cuagucaacgccauguuca

SEQ ID NO: 1816 - RNA, 19 nt, Artificial Sequence
  Chemically synthesized
agaaugaccuggccgcaga

SEQ ID NO: 1817 - RNA, 19 nt, Artificial Sequence
  Chemically synthesized
agcugcugcgcucacucaa

SEQ ID NO: 1818 - RNA, 19 nt, Artificial Sequence
  Chemically synthesized
cucuaucccaaccucucca

SEQ ID NO: 1819 - RNA, 19 nt, Artificial Sequence
  Chemically synthesized
gcgagcugcugcgcucaca

SEQ ID NO: 1820 - RNA, 19 nt, Artificial Sequence
  Chemically synthesized
cgcagcagcaagcagcaca

SEQ ID NO: 1821 - RNA, 19 nt, Artificial Sequence
  Chemically synthesized
ggcugggcugggccugaca

SEQ ID NO: 1822 - RNA, 19 nt, Artificial Sequence
  Chemically synthesized
ucuccagccucaucaucca

SEQ ID NO: 1823 - RNA, 19 nt, Artificial Sequence
  Chemically synthesized
caacgccauguucuucaaa

SEQ ID NO: 1824 - RNA, 19 nt, Artificial Sequence
  Chemically synthesized
uggcacugcggagaaguua

SEQ ID NO: 1825 - RNA, 19 nt, Artificial Sequence
  Chemically synthesized
uuugaguuggacacagaua

SEQ ID NO: 1826 - RNA, 19 nt, Artificial Sequence
  Chemically synthesized
ugggcgagcugcugcgcua

SEQ ID NO: 1827 - RNA, 19 nt, Artificial Sequence
  Chemically synthesized
cugcuaaccaaagagcaga

SEQ ID NO: 1828 - RNA, 19 nt, Artificial Sequence
  Chemically synthesized
aacgugaccuggaagcuga

SEQ ID NO: 1829 - RNA, 19 nt, Artificial Sequence
  Chemically synthesized
augacauuuuguuggagca

SEQ ID NO: 1830 - RNA, 19 nt, Artificial Sequence
  Chemically synthesized
caggaggcauccaaaggca

SEQ ID NO: 1831 - RNA, 19 nt, Artificial Sequence
  Chemically synthesized
aucuccuugcccaagggua

SEQ ID NO: 1832 - RNA, 19 nt, Artificial Sequence
  Chemically synthesized
ugggaugagaaauuccaca

SEQ ID NO: 1833 - RNA, 19 nt, Artificial Sequence
  Chemically synthesized
aaagcugcuaaccaaagaa

SEQ ID NO: 1834 - RNA, 19 nt, Artificial Sequence
  Chemically synthesized
aggaggcauccaaaggcua

SEQ ID NO: 1835 - RNA, 19 nt, Artificial Sequence
  Chemically synthesized
caccgccuuugaguuggaa

SEQ ID NO: 1836 - RNA, 19 nt, Artificial Sequence
  Chemically synthesized
ccaacuauaaaacuaggua

SEQ ID NO: 1837 - RNA, 19 nt, Artificial Sequence
  Chemically synthesized
caagaagcaucgugucuga

SEQ ID NO: 1838 - RNA, 19 nt, Artificial Sequence
  Chemically synthesized
agcagcugaagaucuggaa

SEQ ID NO: 1839 - RNA, 19 nt, Artificial Sequence
  Chemically synthesized
gcgcucccuccugcuucua

SEQ ID NO: 1840 - RNA, 19 nt, Artificial Sequence
  Chemically synthesized
ugcuagucaacgccaugua

SEQ ID NO: 1841 - RNA, 19 nt, Artificial Sequence
  Chemically synthesized
cgccgagcagcugcgcgaa

SEQ ID NO: 1842 - RNA, 19 nt, Artificial Sequence
  Chemically synthesized
ccgcgcagaccaccgacga

SEQ ID NO: 1843 - RNA, 19 nt, Artificial Sequence
  Chemically synthesized
uagccagguaccuucucaa

SEQ ID NO: 1844 - RNA, 19 nt, Artificial Sequence
  Chemically synthesized
ugcuucucagcgccuucua

SEQ ID NO: 1845 - RNA, 19 nt, Artificial Sequence
  Chemically synthesized
cucccuccugcuucucaga

SEQ ID NO: 1846 - RNA, 19 nt, Artificial Sequence
  Chemically synthesized
cgcaggccaaggcagugca

SEQ ID NO: 1847 - RNA, 19 nt, Artificial Sequence
  Chemically synthesized
gcaaggcgaccacggcgua

SEQ ID NO: 1848 - RNA, 19 nt, Artificial Sequence
  Chemically synthesized
gcagccgcagcagcuccua

SEQ ID NO: 1849 - RNA, 19 nt, Artificial Sequence
  Chemically synthesized
uuugauagcaacaaaggcu

SEQ ID NO: 1850 - RNA, 19 nt, Artificial Sequence
  Chemically synthesized
uaucuugucacccuuaggc

SEQ ID NO: 1851 - RNA, 19 nt, Artificial Sequence
  Chemically synthesized
uucuugucacccuuaggcc

SEQ ID NO: 1852 - RNA, 19 nt, Artificial Sequence
  Chemically synthesized
uuaugaauacugauugagg

SEQ ID NO: 1853 - RNA, 19 nt, Artificial Sequence
  Chemically synthesized
ugcuccuucucaauccgcc

SEQ ID NO: 1854 - RNA, 19 nt, Artificial Sequence
  Chemically synthesized
uaggauguucuccacugcc

SEQ ID NO: 1855 - RNA, 19 nt, Artificial Sequence
  Chemically synthesized
uaagagggcuggcugaccc

SEQ ID NO: 1856 - RNA, 19 nt, Artificial Sequence
  Chemically synthesized
uucucgcaucuugucaccc

SEQ ID NO: 1857 - RNA, 19 nt, Artificial Sequence
  Chemically synthesized
uuucuccacugccuggucc

SEQ ID NO: 1858 - RNA, 19 nt, Artificial Sequence
  Chemically synthesized
uauagcacccaugugucuc

SEQ ID NO: 1859 - RNA, 19 nt, Artificial Sequence
  Chemically synthesized
uuuuuuuccacgcuccaac

SEQ ID NO: 1860 - RNA, 19 nt, Artificial Sequence
  Chemically synthesized
uaacaaaggcucauguucc

SEQ ID NO: 1861 - RNA, 19 nt, Artificial Sequence
  Chemically synthesized
uuggcuugaagaacauggc

SEQ ID NO: 1862 - RNA, 19 nt, Artificial Sequence
  Chemically synthesized
uggagcuccuucucaaucc

SEQ ID NO: 1863 - RNA, 19 nt, Artificial Sequence
  Chemically synthesized
uaaacaaaaaguucauccc

SEQ ID NO: 1864 - RNA, 19 nt, Artificial Sequence
  Chemically synthesized
uaauccgccucacugcggc

SEQ ID NO: 1865 - RNA, 19 nt, Artificial Sequence
  Chemically synthesized
uuucuagcugggaaggucc

SEQ ID NO: 1866 - RNA, 19 nt, Artificial Sequence
  Chemically synthesized
uauucuagcugggaagguc

SEQ ID NO: 1867 - RNA, 19 nt, Artificial Sequence
  Chemically synthesized
uucaauuuggucucacagg

SEQ ID NO: 1868 - RNA, 19 nt, Artificial Sequence
  Chemically synthesized
uacaccaggauguucucca

SEQ ID NO: 1869 - RNA, 19 nt, Artificial Sequence
  Chemically synthesized
uauugauagcaacaaaggc

SEQ ID NO: 1870 - RNA, 19 nt, Artificial Sequence
  Chemically synthesized
uuguccaacucaaaggcgg

SEQ ID NO: 1871 - RNA, 19 nt, Artificial Sequence
  Chemically synthesized
ugauguucuccacugccug

SEQ ID NO: 1872 - RNA, 19 nt, Artificial Sequence
  Chemically synthesized
uaauuuggucucacaggug

SEQ ID NO: 1873 - RNA, 19 nt, Artificial Sequence
  Chemically synthesized
ucuucuucugcaucuuccc

SEQ ID NO: 1874 - RNA, 19 nt, Artificial Sequence
  Chemically synthesized
uuuguucuugucaauggcc

SEQ ID NO: 1875 - RNA, 19 nt, Artificial Sequence
  Chemically synthesized
uuguguccaacucaaaggc

SEQ ID NO: 1876 - RNA, 19 nt, Artificial Sequence
  Chemically synthesized
uuagcugggaagguccgcu

SEQ ID NO: 1877 - RNA, 19 nt, Artificial Sequence
  Chemically synthesized
uauggcaacagccuucuuc

SEQ ID NO: 1878 - RNA, 19 nt, Artificial Sequence
  Chemically synthesized
uacucgucucgcaucuugu

SEQ ID NO: 1879 - RNA, 19 nt, Artificial Sequence
  Chemically synthesized
uuccuucucaauccgccuc

SEQ ID NO: 1880 - RNA, 19 nt, Artificial Sequence
  Chemically synthesized
uaugaagccacgguugucc

SEQ ID NO: 1881 - RNA, 19 nt, Artificial Sequence
  Chemically synthesized
uuaccuggcuauaaauaug

SEQ ID NO: 1882 - RNA, 19 nt, Artificial Sequence
  Chemically synthesized
uuuuuccuucucgucgucg

SEQ ID NO: 1883 - RNA, 19 nt, Artificial Sequence
  Chemically synthesized
uuuuggucucacaggugag

SEQ ID NO: 1884 - RNA, 19 nt, Artificial Sequence
  Chemically synthesized
uugaauagcagggagccgc

SEQ ID NO: 1885 - RNA, 19 nt, Artificial Sequence
  Chemically synthesized
ugugacaccaggauguucu

SEQ ID NO: 1886 - RNA, 19 nt, Artificial Sequence
  Chemically synthesized
uauuucucaucccagugug

SEQ ID NO: 1887 - RNA, 19 nt, Artificial Sequence
  Chemically synthesized
uaguggagugaauucuagc

SEQ ID NO: 1888 - RNA, 19 nt, Artificial Sequence
  Chemically synthesized
ugcacuaggaagaugaagg

SEQ ID NO: 1889 - RNA, 19 nt, Artificial Sequence
  Chemically synthesized
uguucuuggauugauagca

SEQ ID NO: 1890 - RNA, 19 nt, Artificial Sequence
  Chemically synthesized
uccuucuucugcaucuucc

SEQ ID NO: 1891 - RNA, 19 nt, Artificial Sequence
  Chemically synthesized
uuagcaacaaaggcucaug

SEQ ID NO: 1892 - RNA, 19 nt, Artificial Sequence
  Chemically synthesized
uagcuccuucucaauccgc

SEQ ID NO: 1893 - RNA, 19 nt, Artificial Sequence
  Chemically synthesized
uacucguugauggacugca

SEQ ID NO: 1894 - RNA, 19 nt, Artificial Sequence
  Chemically synthesized
uucaacuucuccgcagugc

SEQ ID NO: 1895 - RNA, 19 nt, Artificial Sequence
  Chemically synthesized
uauguucuccacugccugg

SEQ ID NO: 1896 - RNA, 19 nt, Artificial Sequence
  Chemically synthesized
uguacagguccuucuugcc

SEQ ID NO: 1897 - RNA, 19 nt, Artificial Sequence
  Chemically synthesized
ugucguaguaguuguagag

SEQ ID NO: 1898 - RNA, 19 nt, Artificial Sequence
  Chemically synthesized
uugaauucuagcugggaag

SEQ ID NO: 1899 - RNA, 19 nt, Artificial Sequence
  Chemically synthesized
ucuccuucucaauccgccu

SEQ ID NO: 1900 - RNA, 19 nt, Artificial Sequence
  Chemically synthesized
ucacccacgguauaggacc

SEQ ID NO: 1901 - RNA, 19 nt, Artificial Sequence
  Chemically synthesized
ugguacagguccuucuugc

SEQ ID NO: 1902 - RNA, 19 nt, Artificial Sequence
  Chemically synthesized
uucaucaugacacccacgg

SEQ ID NO: 1903 - RNA, 19 nt, Artificial Sequence
  Chemically synthesized
uuauaacucgucucgcauc

SEQ ID NO: 1904 - RNA, 19 nt, Artificial Sequence
  Chemically synthesized
uucggcgcucagcacugcc

SEQ ID NO: 1905 - RNA, 19 nt, Artificial Sequence
  Chemically synthesized
uuggagugaauucuagcug

SEQ ID NO: 1906 - RNA, 19 nt, Artificial Sequence
  Chemically synthesized
uaagucaucagcgaagcuc

SEQ ID NO: 1907 - RNA, 19 nt, Artificial Sequence
  Chemically synthesized
uucuguguccaacucaaag

SEQ ID NO: 1908 - RNA, 19 nt, Artificial Sequence
  Chemically synthesized
uaagccacgguuguccacc

SEQ ID NO: 1909 - RNA, 19 nt, Artificial Sequence
  Chemically synthesized
ugcaugaggaugaugaggc

SEQ ID NO: 1910 - RNA, 19 nt, Artificial Sequence
  Chemically synthesized
uuguucuccacugccuggu

SEQ ID NO: 1911 - RNA, 19 nt, Artificial Sequence
  Chemically synthesized
uaauacugauugaggcagg

SEQ ID NO: 1912 - RNA, 19 nt, Artificial Sequence
  Chemically synthesized
uauugaggcaggcuugauc

SEQ ID NO: 1913 - RNA, 19 nt, Artificial Sequence
  Chemically synthesized
ucuucuugaccagagucug

SEQ ID NO: 1914 - RNA, 19 nt, Artificial Sequence
  Chemically synthesized
uuugauggacugcagcgcg

SEQ ID NO: 1915 - RNA, 19 nt, Artificial Sequence
  Chemically synthesized
uacuucuccgcagugccag

SEQ ID NO: 1916 - RNA, 19 nt, Artificial Sequence
  Chemically synthesized
uagguugggauagagcugg

SEQ ID NO: 1917 - RNA, 19 nt, Artificial Sequence
  Chemically synthesized
uucaccuccaccacacccu

SEQ ID NO: 1918 - RNA, 19 nt, Artificial Sequence
  Chemically synthesized
uuucucaauccgccucacu

SEQ ID NO: 1919 - RNA, 19 nt, Artificial Sequence
  Chemically synthesized
uguuguagaggccuguccg

SEQ ID NO: 1920 - RNA, 19 nt, Artificial Sequence
  Chemically synthesized
uagcuuuuccuucucgucg

SEQ ID NO: 1921 - RNA, 19 nt, Artificial Sequence
  Chemically synthesized
uucagcacugccuuggccu

SEQ ID NO: 1922 - RNA, 19 nt, Artificial Sequence
  Chemically synthesized
ucugugugcacccugaggc

SEQ ID NO: 1923 - RNA, 19 nt, Artificial Sequence
  Chemically synthesized
uugguggaauuucucaucc

SEQ ID NO: 1924 - RNA, 19 nt, Artificial Sequence
  Chemically synthesized
uuuugcagcuuuuccuucu

SEQ ID NO: 1925 - RNA, 19 nt, Artificial Sequence
  Chemically synthesized
uagagguugggauagagcu

SEQ ID NO: 1926 - RNA, 19 nt, Artificial Sequence
  Chemically synthesized
uucgucucgcaucuuguca

SEQ ID NO: 1927 - RNA, 19 nt, Artificial Sequence
  Chemically synthesized
ucuccugggagcuccuucu

SEQ ID NO: 1928 - RNA, 19 nt, Artificial Sequence
  Chemically synthesized
ugucucacaggugagaagg

SEQ ID NO: 1929 - RNA, 19 nt, Artificial Sequence
  Chemically synthesized
uagagucugcccagaagcc

SEQ ID NO: 1930 - RNA, 19 nt, Artificial Sequence
  Chemically synthesized
uugaggaugaugaggcugg

SEQ ID NO: 1931 - RNA, 19 nt, Artificial Sequence
  Chemically synthesized
uugucucaggagccuuugg

SEQ ID NO: 1932 - RNA, 19 nt, Artificial Sequence
  Chemically synthesized
uugacuauggcccaggucc

SEQ ID NO: 1933 - RNA, 19 nt, Artificial Sequence
  Chemically synthesized
uugcaucaucaugacaccc

SEQ ID NO: 1934 - RNA, 19 nt, Artificial Sequence
  Chemically synthesized
uaguauccaaggcugguac

SEQ ID NO: 1935 - RNA, 19 nt, Artificial Sequence
  Chemically synthesized
uaaggagauggcaacagcc

SEQ ID NO: 1936 - RNA, 19 nt, Artificial Sequence
  Chemically synthesized
uucaauccgccucacugcg

SEQ ID NO: 1937 - RNA, 19 nt, Artificial Sequence
  Chemically synthesized
uugcgcuccacguccuugg

SEQ ID NO: 1938 - RNA, 19 nt, Artificial Sequence
  Chemically synthesized
uccaugugucucaggagcc

SEQ ID NO: 1939 - RNA, 19 nt, Artificial Sequence
  Chemically synthesized
uucguugauggacugcagc

SEQ ID NO: 1940 - RNA, 19 nt, Artificial Sequence
  Chemically synthesized
uaggugagaagguaccugg

SEQ ID NO: 1941 - RNA, 19 nt, Artificial Sequence
  Chemically synthesized
uuggacugcagcgcgcugc

SEQ ID NO: 1942 - RNA, 19 nt, Artificial Sequence
  Chemically synthesized
ucuagcucaauuuggucuc

SEQ ID NO: 1943 - RNA, 19 nt, Artificial Sequence
  Chemically synthesized
uuuucuucaccucggcggc

SEQ ID NO: 1944 - RNA, 19 nt, Artificial Sequence
  Chemically synthesized
uuucuugaccagagucugc

SEQ ID NO: 1945 - RNA, 19 nt, Artificial Sequence
  Chemically synthesized
uaaguggagugaauucuag

SEQ ID NO: 1946 - RNA, 19 nt, Artificial Sequence
  Chemically synthesized
ucaggauguucuccacugc

SEQ ID NO: 1947 - RNA, 19 nt, Artificial Sequence
  Chemically synthesized
ucuucuugccugacaugcg

SEQ ID NO: 1948 - RNA, 19 nt, Artificial Sequence
  Chemically synthesized
ugagcuccuucucaauccg

SEQ ID NO: 1949 - RNA, 19 nt, Artificial Sequence
  Chemically synthesized
uaaggcugguaccucaccu

SEQ ID NO: 1950 - RNA, 19 nt, Artificial Sequence
  Chemically synthesized
uuuucucaucccagugugg

SEQ ID NO: 1951 - RNA, 19 nt, Artificial Sequence
  Chemically synthesized
ucuuguucuugucaauggc

SEQ ID NO: 1952 - RNA, 19 nt, Artificial Sequence
  Chemically synthesized
uguugauggacugcagcgc

SEQ ID NO: 1953 - RNA, 19 nt, Artificial Sequence
  Chemically synthesized
uuaguuuuauaguugggag

SEQ ID NO: 1954 - RNA, 19 nt, Artificial Sequence
  Chemically synthesized
ugucucgcaucuugucacc

SEQ ID NO: 1955 - RNA, 19 nt, Artificial Sequence
  Chemically synthesized
uaugcgugacaagucggcc

SEQ ID NO: 1956 - RNA, 19 nt, Artificial Sequence
  Chemically synthesized
ucaucuugucacccuuagg

SEQ ID NO: 1957 - RNA, 19 nt, Artificial Sequence
  Chemically synthesized
uuagcacccaugugucuca

SEQ ID NO: 1958 - RNA, 19 nt, Artificial Sequence
  Chemically synthesized
ucggucuguuuuuccaccc

SEQ ID NO: 1959 - RNA, 19 nt, Artificial Sequence
  Chemically synthesized
uucaugggucaccuccacc

SEQ ID NO: 1960 - RNA, 19 nt, Artificial Sequence
  Chemically synthesized
uuagauguccuggucaaag

SEQ ID NO: 1961 - RNA, 19 nt, Artificial Sequence
  Chemically synthesized
ucaacaaaggcucauguuc

SEQ ID NO: 1962 - RNA, 19 nt, Artificial Sequence
  Chemically synthesized
ucauggaguauccaaggcu

SEQ ID NO: 1963 - RNA, 19 nt, Artificial Sequence
  Chemically synthesized
uaggucaugggucaccucc

SEQ ID NO: 1964 - RNA, 19 nt, Artificial Sequence
  Chemically synthesized
uuugaggcaggcuugaucu

SEQ ID NO: 1965 - RNA, 19 nt, Artificial Sequence
  Chemically synthesized
uuccaccacacccuugggc

SEQ ID NO: 1966 - RNA, 19 nt, Artificial Sequence
  Chemically synthesized
uacaagucggccuuguucu

SEQ ID NO: 1967 - RNA, 19 nt, Artificial Sequence
  Chemically synthesized
ugagucaccaugaagccac

SEQ ID NO: 1968 - RNA, 19 nt, Artificial Sequence
  Chemically synthesized
uacccaugugucucaggag

SEQ ID NO: 1969 - RNA, 19 nt, Artificial Sequence
  Chemically synthesized
uauggaguauccaaggcug

SEQ ID NO: 1970 - RNA, 19 nt, Artificial Sequence
  Chemically synthesized
uaugugucucaggagccuu

SEQ ID NO: 1971 - RNA, 19 nt, Artificial Sequence
  Chemically synthesized
uuggcaacagccuucuucu

SEQ ID NO: 1972 - RNA, 19 nt, Artificial Sequence
  Chemically synthesized
uuucucgucgucguaguag

SEQ ID NO: 1973 - RNA, 19 nt, Artificial Sequence
  Chemically synthesized
ugauugauagcaacaaagg

SEQ ID NO: 1974 - RNA, 19 nt, Artificial Sequence
  Chemically synthesized
uggauguucuccacugccu

SEQ ID NO: 1975 - RNA, 19 nt, Artificial Sequence
  Chemically synthesized
uagaggcuccacgugaugg

SEQ ID NO: 1976 - RNA, 19 nt, Artificial Sequence
  Chemically synthesized
uugaugaggcuggagagcu

SEQ ID NO: 1977 - RNA, 19 nt, Artificial Sequence
  Chemically synthesized
uaaugaauagcagggagcc

SEQ ID NO: 1978 - RNA, 19 nt, Artificial Sequence
  Chemically synthesized
uacaaaggcucauguuccc

SEQ ID NO: 1979 - RNA, 19 nt, Artificial Sequence
  Chemically synthesized
ugcagaaugacuauggccc

SEQ ID NO: 1980 - RNA, 19 nt, Artificial Sequence
  Chemically synthesized
uucuucagcugcucuuugg

SEQ ID NO: 1981 - RNA, 19 nt, Artificial Sequence
  Chemically synthesized
ucagcuuuuccuucucguc

SEQ ID NO: 1982 - RNA, 19 nt, Artificial Sequence
  Chemically synthesized
ugagucugcccagaagccc

SEQ ID NO: 1983 - RNA, 19 nt, Artificial Sequence
  Chemically synthesized
uuccacugccugguccuug

SEQ ID NO: 1984 - RNA, 19 nt, Artificial Sequence
  Chemically synthesized
ucucaauuuggucucacag

SEQ ID NO: 1985 - RNA, 19 nt, Artificial Sequence
  Chemically synthesized
uuugucaauggccucaguc

SEQ ID NO: 1986 - RNA, 19 nt, Artificial Sequence
  Chemically synthesized
uugacaugcgugacaaguc

SEQ ID NO: 1987 - RNA, 19 nt, Artificial Sequence
  Chemically synthesized
uaggcugguaccucaccuc

SEQ ID NO: 1988 - RNA, 19 nt, Artificial Sequence
  Chemically synthesized
uucagcaucaugguaucug

SEQ ID NO: 1989 - RNA, 19 nt, Artificial Sequence
  Chemically synthesized
uuacagguccuucuugccu

SEQ ID NO: 1990 - RNA, 19 nt, Artificial Sequence
  Chemically synthesized
uuggaauuucucaucccag

SEQ ID NO: 1991 - RNA, 19 nt, Artificial Sequence
  Chemically synthesized
uuauccaaggcugguaccu

SEQ ID NO: 1992 - RNA, 19 nt, Artificial Sequence
  Chemically synthesized
uucagaagagggcuggcug

SEQ ID NO: 1993 - RNA, 19 nt, Artificial Sequence
  Chemically synthesized
uggugcaucaucaugacac

SEQ ID NO: 1994 - RNA, 19 nt, Artificial Sequence
  Chemically synthesized
uucguaguaguuguagagg

SEQ ID NO: 1995 - RNA, 19 nt, Artificial Sequence
  Chemically synthesized
uguuucuucaccucggcgg

SEQ ID NO: 1996 - RNA, 19 nt, Artificial Sequence
  Chemically synthesized
uaguucuuggauugauagc

SEQ ID NO: 1997 - RNA, 19 nt, Artificial Sequence
  Chemically synthesized
uuacugauugaggcaggcu

SEQ ID NO: 1998 - RNA, 19 nt, Artificial Sequence
  Chemically synthesized
uucacccuuaggccggacc

SEQ ID NO: 1999 - RNA, 19 nt, Artificial Sequence
  Chemically synthesized
uauuugcagcuuuuccuuc

SEQ ID NO: 2000 - RNA, 19 nt, Artificial Sequence
  Chemically synthesized
uguaguaguuguagaggcc

SEQ ID NO: 2001 - RNA, 19 nt, Artificial Sequence
  Chemically synthesized
uaguguggcuugaagaaca

SEQ ID NO: 2002 - RNA, 19 nt, Artificial Sequence
  Chemically synthesized
ucucagcacugccuuggcc

SEQ ID NO: 2003 - RNA, 19 nt, Artificial Sequence
  Chemically synthesized
uucuugugguggaauuucu

SEQ ID NO: 2004 - RNA, 19 nt, Artificial Sequence
  Chemically synthesized
ucucguugauggacugcag

SEQ ID NO: 2005 - RNA, 19 nt, Artificial Sequence
  Chemically synthesized
uuggcguggaacacgcugg

SEQ ID NO: 2006 - RNA, 19 nt, Artificial Sequence
  Chemically synthesized
uugagaagcaggagggagc

SEQ ID NO: 2007 - RNA, 19 nt, Artificial Sequence
  Chemically synthesized
uuuguagaggccuguccgg

SEQ ID NO: 2008 - RNA, 19 nt, Artificial Sequence
  Chemically synthesized
ugaggcuccacgugauggg

SEQ ID NO: 2009 - RNA, 19 nt, Artificial Sequence
  Chemically synthesized
uuugucacccuuaggccgg

SEQ ID NO: 2010 - RNA, 19 nt, Artificial Sequence
  Chemically synthesized
uugacacccacgguauagg

SEQ ID NO: 2011 - RNA, 19 nt, Artificial Sequence
  Chemically synthesized
uccaggauguucuccacug

SEQ ID NO: 2012 - RNA, 19 nt, Artificial Sequence
  Chemically synthesized
ugaauuucucaucccagug

SEQ ID NO: 2013 - RNA, 19 nt, Artificial Sequence
  Chemically synthesized
uucucaggagccuuuggau

SEQ ID NO: 2014 - RNA, 19 nt, Artificial Sequence
  Chemically synthesized
uuugugguggaauuucuca

SEQ ID NO: 2015 - RNA, 19 nt, Artificial Sequence
  Chemically synthesized
uccggucuguuuuuccacc

SEQ ID NO: 2016 - RNA, 19 nt, Artificial Sequence
  Chemically synthesized
uuacagucggcugcccagc

SEQ ID NO: 2017 - RNA, 19 nt, Artificial Sequence
  Chemically synthesized
ucaggcagaaugacuaugg

SEQ ID NO: 2018 - RNA, 19 nt, Artificial Sequence
  Chemically synthesized
uuagaggccuguccggugc

SEQ ID NO: 2019 - RNA, 19 nt, Artificial Sequence
  Chemically synthesized
uuugccaucuguguccaac

SEQ ID NO: 2020 - RNA, 19 nt, Artificial Sequence
  Chemically synthesized
uauacugauugaggcaggc

SEQ ID NO: 2021 - RNA, 19 nt, Artificial Sequence
  Chemically synthesized
uuugucgcggaaguugauc

SEQ ID NO: 2022 - RNA, 19 nt, Artificial Sequence
  Chemically synthesized
uauccgccucacugcggcc

SEQ ID NO: 2023 - RNA, 19 nt, Artificial Sequence
  Chemically synthesized
uggcucaacuucuccgcag

SEQ ID NO: 2024 - RNA, 19 nt, Artificial Sequence
  Chemically synthesized
uucaggagccuuuggaugc

SEQ ID NO: 2025 - RNA, 19 nt, Artificial Sequence
  Chemically synthesized
ucagagucugcccagaagc

SEQ ID NO: 2026 - RNA, 19 nt, Artificial Sequence
  Chemically synthesized
ugugucagaagagggcugg

SEQ ID NO: 2027 - RNA, 19 nt, Artificial Sequence
  Chemically synthesized
ugagagguugggauagagc

SEQ ID NO: 2028 - RNA, 19 nt, Artificial Sequence
  Chemically synthesized
uuccgugcgcuccacgucc

SEQ ID NO: 2029 - RNA, 19 nt, Artificial Sequence
  Chemically synthesized
ucgcucagcacugccuugg

SEQ ID NO: 2030 - RNA, 19 nt, Artificial Sequence
  Chemically synthesized
ugcaacagccuucuucugc

SEQ ID NO: 2031 - RNA, 19 nt, Artificial Sequence
  Chemically synthesized
uacgcuccaacaaaauguc

SEQ ID NO: 2032 - RNA, 19 nt, Artificial Sequence
  Chemically synthesized
uuugaucuuggagugcucg

SEQ ID NO: 2033 - RNA, 19 nt, Artificial Sequence
  Chemically synthesized
uuccggugcaucaucauga

SEQ ID NO: 2034 - RNA, 19 nt, Artificial Sequence
  Chemically synthesized
uaaggcgcugagaagcagg

SEQ ID NO: 2035 - RNA, 19 nt, Artificial Sequence
  Chemically synthesized
uuaguugggagagguuggg

SEQ ID NO: 2036 - RNA, 19 nt, Artificial Sequence
  Chemically synthesized
uuugaccagagucugccca

SEQ ID NO: 2037 - RNA, 19 nt, Artificial Sequence
  Chemically synthesized
ugaugcuucuugaccagag

SEQ ID NO: 2038 - RNA, 19 nt, Artificial Sequence
  Chemically synthesized
uaaggcgcucgagaggcuc

SEQ ID NO: 2039 - RNA, 19 nt, Artificial Sequence
  Chemically synthesized
uagauggcaacagccuucu

SEQ ID NO: 2040 - RNA, 19 nt, Artificial Sequence
  Chemically synthesized
uuggcguugacuagcaggg

SEQ ID NO: 2041 - RNA, 19 nt, Artificial Sequence
  Chemically synthesized
ucugguacaagcugaaggc

SEQ ID NO: 2042 - RNA, 19 nt, Artificial Sequence
  Chemically synthesized
uugcucuuugguuagcagc

SEQ ID NO: 2043 - RNA, 19 nt, Artificial Sequence
  Chemically synthesized
uggcuggagagcuuguggg

SEQ ID NO: 2044 - RNA, 19 nt, Artificial Sequence
  Chemically synthesized
ucaaugaauagcagggagc

SEQ ID NO: 2045 - RNA, 19 nt, Artificial Sequence
  Chemically synthesized
uucccuaucuuugaagaac

SEQ ID NO: 2046 - RNA, 19 nt, Artificial Sequence
  Chemically synthesized
uagaagagggcuggcugac

SEQ ID NO: 2047 - RNA, 19 nt, Artificial Sequence
  Chemically synthesized
uccgcuuugggugucccgc

SEQ ID NO: 2048 - RNA, 19 nt, Artificial Sequence
  Chemically synthesized
uacugcagcgcgcugcgcu

SEQ ID NO: 2049 - RNA, 19 nt, Artificial Sequence
  Chemically synthesized
uaggauguggaguuuccgg

SEQ ID NO: 2050 - RNA, 19 nt, Artificial Sequence
  Chemically synthesized
uccuuguucuugucaaugg

SEQ ID NO: 2051 - RNA, 19 nt, Artificial Sequence
  Chemically synthesized
uucgcgcccguagaugucc

SEQ ID NO: 2052 - RNA, 19 nt, Artificial Sequence
  Chemically synthesized
ucaauagcacccauguguc

SEQ ID NO: 2053 - RNA, 19 nt, Artificial Sequence
  Chemically synthesized
ucuucuccgcagugccagg

SEQ ID NO: 2054 - RNA, 19 nt, Artificial Sequence
  Chemically synthesized
uauggccucagucaggccc

SEQ ID NO: 2055 - RNA, 19 nt, Artificial Sequence
  Chemically synthesized
uaauuucucaucccagugu

SEQ ID NO: 2056 - RNA, 19 nt, Artificial Sequence
  Chemically synthesized
ugaagagggcuggcugacc

SEQ ID NO: 2057 - RNA, 19 nt, Artificial Sequence
  Chemically synthesized
ucuucucaauccgccucac

SEQ ID NO: 2058 - RNA, 19 nt, Artificial Sequence
  Chemically synthesized
uauuuggucucacagguga

SEQ ID NO: 2059 - RNA, 19 nt, Artificial Sequence
  Chemically synthesized
uucuccacgauuugcagcu

SEQ ID NO: 2060 - RNA, 19 nt, Artificial Sequence
  Chemically synthesized
uugccauccugugugcacc

SEQ ID NO: 2061 - RNA, 19 nt, Artificial Sequence
  Chemically synthesized
ugucaccuccaccacaccc

SEQ ID NO: 2062 - RNA, 19 nt, Artificial Sequence
  Chemically synthesized
uuggaguauccaaggcugg

SEQ ID NO: 2063 - RNA, 19 nt, Artificial Sequence
  Chemically synthesized
uaggcuggagagcuugugg

SEQ ID NO: 2064 - RNA, 19 nt, Artificial Sequence
  Chemically synthesized
uugugucucaggagccuuu

SEQ ID NO: 2065 - RNA, 19 nt, Artificial Sequence
  Chemically synthesized
ucgauuugcagcuuuuccu

SEQ ID NO: 2066 - RNA, 19 nt, Artificial Sequence
  Chemically synthesized
ugugccaggagcugcugcg

SEQ ID NO: 2067 - RNA, 19 nt, Artificial Sequence
  Chemically synthesized
ugugcaucaucaugacacc

SEQ ID NO: 2068 - RNA, 19 nt, Artificial Sequence
  Chemically synthesized
uuuuuagugucagaagagg

SEQ ID NO: 2069 - RNA, 19 nt, Artificial Sequence
  Chemically synthesized
uguggagugaauucuagcu

SEQ ID NO: 2070 - RNA, 19 nt, Artificial Sequence
  Chemically synthesized
uucgccuugccgcccagcg

SEQ ID NO: 2071 - RNA, 19 nt, Artificial Sequence
  Chemically synthesized
ucaagcugaaggccaggcc

SEQ ID NO: 2072 - RNA, 19 nt, Artificial Sequence
  Chemically synthesized
uaauagcacccaugugucu

SEQ ID NO: 2073 - RNA, 19 nt, Artificial Sequence
  Chemically synthesized
uaucaucaugacacccacg

SEQ ID NO: 2074 - RNA, 19 nt, Artificial Sequence
  Chemically synthesized
ucaucaucaugacacccac

SEQ ID NO: 2075 - RNA, 19 nt, Artificial Sequence
  Chemically synthesized
uuccugggagcuccuucuc

SEQ ID NO: 2076 - RNA, 19 nt, Artificial Sequence
  Chemically synthesized
uugcuucuugaccagaguc

SEQ ID NO: 2077 - RNA, 19 nt, Artificial Sequence
  Chemically synthesized
uagcugagguguuuuagug

SEQ ID NO: 2078 - RNA, 19 nt, Artificial Sequence
  Chemically synthesized
ugagccuuuggaugccucc

SEQ ID NO: 2079 - RNA, 19 nt, Artificial Sequence
  Chemically synthesized
uagcucacugagcuggguc

SEQ ID NO: 2080 - RNA, 19 nt, Artificial Sequence
  Chemically synthesized
uuguuucugcaggucaugg

SEQ ID NO: 2081 - RNA, 19 nt, Artificial Sequence
  Chemically synthesized
ucagccuucuucugcaucu

SEQ ID NO: 2082 - RNA, 19 nt, Artificial Sequence
  Chemically synthesized
uuuguagugcugcuugcug

SEQ ID NO: 2083 - RNA, 19 nt, Artificial Sequence
  Chemically synthesized
uaugaggcuggagagcuug

SEQ ID NO: 2084 - RNA, 19 nt, Artificial Sequence
  Chemically synthesized
ucaacagccuucuucugca

SEQ ID NO: 2085 - RNA, 19 nt, Artificial Sequence
  Chemically synthesized
uugcgcagcuccucgcgcc

SEQ ID NO: 2086 - RNA, 19 nt, Artificial Sequence
  Chemically synthesized
uguauccaaggcugguacc

SEQ ID NO: 2087 - RNA, 19 nt, Artificial Sequence
  Chemically synthesized
uguccguacagucggcugc

SEQ ID NO: 2088 - RNA, 19 nt, Artificial Sequence
  Chemically synthesized
uaugaggaugaugaggcug

SEQ ID NO: 2089 - RNA, 19 nt, Artificial Sequence
  Chemically synthesized
ucaacucaaaggcgguggc

SEQ ID NO: 2090 - RNA, 19 nt, Artificial Sequence
  Chemically synthesized
uccagguacagguccuucu

SEQ ID NO: 2091 - RNA, 19 nt, Artificial Sequence
  Chemically synthesized
ugcugcagguuucuucacc

SEQ ID NO: 2092 - RNA, 19 nt, Artificial Sequence
  Chemically synthesized
uucacaggugagaagguac

SEQ ID NO: 2093 - RNA, 19 nt, Artificial Sequence
  Chemically synthesized
uacugccugguccuuggcc

SEQ ID NO: 2094 - RNA, 19 nt, Artificial Sequence
  Chemically synthesized
ucguggucgccuugccgcc

SEQ ID NO: 2095 - RNA, 19 nt, Artificial Sequence
  Chemically synthesized
uaguugaucuuggagugcu

SEQ ID NO: 2096 - RNA, 19 nt, Artificial Sequence
  Chemically synthesized
uguaccuggcuauaaauau

SEQ ID NO: 2097 - RNA, 19 nt, Artificial Sequence
  Chemically synthesized
uuccguacagucggcugcc

SEQ ID NO: 2098 - RNA, 19 nt, Artificial Sequence
  Chemically synthesized
uuugccugacaugcgugac

SEQ ID NO: 2099 - RNA, 19 nt, Artificial Sequence
  Chemically synthesized
uuaguuguagaggccuguc

SEQ ID NO: 2100 - RNA, 19 nt, Artificial Sequence
  Chemically synthesized
uacagccuucuucugcauc

SEQ ID NO: 2101 - RNA, 19 nt, Artificial Sequence
  Chemically synthesized
uuuucugcaggucaugggu

SEQ ID NO: 2102 - RNA, 19 nt, Artificial Sequence
  Chemically synthesized
uccgagucaccaugaagcc

SEQ ID NO: 2103 - RNA, 19 nt, Artificial Sequence
  Chemically synthesized
uugaauacugauugaggca

SEQ ID NO: 2104 - RNA, 19 nt, Artificial Sequence
  Chemically synthesized
ucaguguggcuugaagaac

SEQ ID NO: 2105 - RNA, 19 nt, Artificial Sequence
  Chemically synthesized
uggaaguugaucuuggagu

SEQ ID NO: 2106 - RNA, 19 nt, Artificial Sequence
  Chemically synthesized
uuggucggcguagaacagc

SEQ ID NO: 2107 - RNA, 19 nt, Artificial Sequence
  Chemically synthesized
uagaacauggcguugacua

SEQ ID NO: 2108 - RNA, 19 nt, Artificial Sequence
  Chemically synthesized
uguccgcucaggcacacgg

SEQ ID NO: 2109 - RNA, 19 nt, Artificial Sequence
  Chemically synthesized
uuaguaguuguagaggccu

SEQ ID NO: 2110 - RNA, 19 nt, Artificial Sequence
  Chemically synthesized
uaccgagucaccaugaagc

SEQ ID NO: 2111 - RNA, 19 nt, Artificial Sequence
  Chemically synthesized
uacacgaugcuucuugacc

SEQ ID NO: 2112 - RNA, 19 nt, Artificial Sequence
  Chemically synthesized
uaucuuggagugcucgcag

SEQ ID NO: 2113 - RNA, 19 nt, Artificial Sequence
  Chemically synthesized
uacacccacgguauaggac

SEQ ID NO: 2114 - RNA, 19 nt, Artificial Sequence
  Chemically synthesized
uaauggccucagucaggcc

SEQ ID NO: 2115 - RNA, 19 nt, Artificial Sequence
  Chemically synthesized
ugaaguugaucuuggagug

SEQ ID NO: 2116 - RNA, 19 nt, Artificial Sequence
  Chemically synthesized
uugccuuggccugcgacgc

SEQ ID NO: 2117 - RNA, 19 nt, Artificial Sequence
  Chemically synthesized
uucgcaucuugucacccuu

SEQ ID NO: 2118 - RNA, 19 nt, Artificial Sequence
  Chemically synthesized
uucggcguagaacagcuug

SEQ ID NO: 2119 - RNA, 19 nt, Artificial Sequence
  Chemically synthesized
uauggcguugacuagcagg

SEQ ID NO: 2120 - RNA, 19 nt, Artificial Sequence
  Chemically synthesized
uccuccaccacacccuugg

SEQ ID NO: 2121 - RNA, 19 nt, Artificial Sequence
  Chemically synthesized
ucuccugccauccugugug

SEQ ID NO: 2122 - RNA, 19 nt, Artificial Sequence
  Chemically synthesized
ucacccaugugucucagga

SEQ ID NO: 2123 - RNA, 19 nt, Artificial Sequence
  Chemically synthesized
uucgucguaguaguuguag

SEQ ID NO: 2124 - RNA, 19 nt, Artificial Sequence
  Chemically synthesized
ucucgucucgcaucuuguc

SEQ ID NO: 2125 - RNA, 19 nt, Artificial Sequence
  Chemically synthesized
uggcugcccagcuuccagg

SEQ ID NO: 2126 - RNA, 19 nt, Artificial Sequence
  Chemically synthesized
uucccaguguggcuugaag

SEQ ID NO: 2127 - RNA, 19 nt, Artificial Sequence
  Chemically synthesized
ucccuauaacucgucucgc

SEQ ID NO: 2128 - RNA, 19 nt, Artificial Sequence
  Chemically synthesized
uagucggcugcccagcuuc

SEQ ID NO: 2129 - RNA, 19 nt, Artificial Sequence
  Chemically synthesized
ugaagguccgcucaggcac

SEQ ID NO: 2130 - RNA, 19 nt, Artificial Sequence
  Chemically synthesized
uugcaggucaugggucacc

SEQ ID NO: 2131 - RNA, 19 nt, Artificial Sequence
  Chemically synthesized
uauagcaacaaaggcucau

SEQ ID NO: 2132 - RNA, 19 nt, Artificial Sequence
  Chemically synthesized
uucgucgucguaguaguug

SEQ ID NO: 2133 - RNA, 19 nt, Artificial Sequence
  Chemically synthesized
uuugcugagugagcgcagc

SEQ ID NO: 2134 - RNA, 19 nt, Artificial Sequence
  Chemically synthesized
uugacaccaggauguucuc

SEQ ID NO: 2135 - RNA, 19 nt, Artificial Sequence
  Chemically synthesized
uggcguagaacagcuuggg

SEQ ID NO: 2136 - RNA, 19 nt, Artificial Sequence
  Chemically synthesized
ugagguugggauagagcug

SEQ ID NO: 2137 - RNA, 19 nt, Artificial Sequence
  Chemically synthesized
uagucaucagcgaagcuca

SEQ ID NO: 2138 - RNA, 19 nt, Artificial Sequence
  Chemically synthesized
uaagcguggccgccuuggg

SEQ ID NO: 2139 - RNA, 19 nt, Artificial Sequence
  Chemically synthesized
uaugacacccacgguauag

SEQ ID NO: 2140 - RNA, 19 nt, Artificial Sequence
  Chemically synthesized
ugccuuguucuugucaaug

SEQ ID NO: 2141 - RNA, 19 nt, Artificial Sequence
  Chemically synthesized
ugcucacugagcugggucc

SEQ ID NO: 2142 - RNA, 19 nt, Artificial Sequence
  Chemically synthesized
ucuuuuccuucucgucguc

SEQ ID NO: 2143 - RNA, 19 nt, Artificial Sequence
  Chemically synthesized
uccguggucgccuugccgc

SEQ ID NO: 2144 - RNA, 19 nt, Artificial Sequence
  Chemically synthesized
uagccgcuuuggguguccc

SEQ ID NO: 2145 - RNA, 19 nt, Artificial Sequence
  Chemically synthesized
ugcugguaccucaccuccc

SEQ ID NO: 2146 - RNA, 19 nt, Artificial Sequence
  Chemically synthesized
uucgcaguuguagugcugc

SEQ ID NO: 2147 - RNA, 19 nt, Artificial Sequence
  Chemically synthesized
uuuccaggucacguugcgc

SEQ ID NO: 2148 - RNA, 19 nt, Artificial Sequence
  Chemically synthesized
ucucagucaggcccagccc

SEQ ID NO: 2149 - RNA, 19 nt, Artificial Sequence
  Chemically synthesized
uugggaagguccgcucagg

SEQ ID NO: 2150 - RNA, 19 nt, Artificial Sequence
  Chemically synthesized
uauccagaucuucagcugc

SEQ ID NO: 2151 - RNA, 19 nt, Artificial Sequence
  Chemically synthesized
uaccaggauguucuccacu

SEQ ID NO: 2152 - RNA, 19 nt, Artificial Sequence
  Chemically synthesized
uaguuguagugcugcuugc

SEQ ID NO: 2153 - RNA, 19 nt, Artificial Sequence
  Chemically synthesized
uagcgaagcucacugagcu

SEQ ID NO: 2154 - RNA, 19 nt, Artificial Sequence
  Chemically synthesized
uacaugcgugacaagucgg

SEQ ID NO: 2155 - RNA, 19 nt, Artificial Sequence
  Chemically synthesized
ucguccuuggugaccucgg

SEQ ID NO: 2156 - RNA, 19 nt, Artificial Sequence
  Chemically synthesized
uaggcgcucgagaggcucc

SEQ ID NO: 2157 - RNA, 19 nt, Artificial Sequence
  Chemically synthesized
uucgguggucugcgcggcc

SEQ ID NO: 2158 - RNA, 19 nt, Artificial Sequence
  Chemically synthesized
uacaggauguggaguuucc

SEQ ID NO: 2159 - RNA, 19 nt, Artificial Sequence
  Chemically synthesized
uuagcagggagccgcuuug

SEQ ID NO: 2160 - RNA, 19 nt, Artificial Sequence
  Chemically synthesized
ucccaugugucucaggagc

SEQ ID NO: 2161 - RNA, 19 nt, Artificial Sequence
  Chemically synthesized
ugaaugacuauggcccagg

SEQ ID NO: 2162 - RNA, 19 nt, Artificial Sequence
  Chemically synthesized
ucgcucgagaggcuccacg

SEQ ID NO: 2163 - RNA, 19 nt, Artificial Sequence
  Chemically synthesized
ugcgcugagaagcaggagg

SEQ ID NO: 2164 - RNA, 19 nt, Artificial Sequence
  Chemically synthesized
ucaggcuugaucugggacu

SEQ ID NO: 2165 - RNA, 19 nt, Artificial Sequence
  Chemically synthesized
uaucaugacacccacggua

SEQ ID NO: 2166 - RNA, 19 nt, Artificial Sequence
  Chemically synthesized
uugucagaagagggcuggc

SEQ ID NO: 2167 - RNA, 19 nt, Artificial Sequence
  Chemically synthesized
ucagguuucuucaccucgg

SEQ ID NO: 2168 - RNA, 19 nt, Artificial Sequence
  Chemically synthesized
uuucuccgcagugccagga

SEQ ID NO: 2169 - RNA, 19 nt, Artificial Sequence
  Chemically synthesized
uggauguggaguuuccggg

SEQ ID NO: 2170 - RNA, 19 nt, Artificial Sequence
  Chemically synthesized
uaugcuucuugaccagagu

SEQ ID NO: 2171 - RNA, 19 nt, Artificial Sequence
  Chemically synthesized
uagcaucaugguaucuggg

SEQ ID NO: 2172 - RNA, 19 nt, Artificial Sequence
  Chemically synthesized
ugcacccaugugucucagg

SEQ ID NO: 2173 - RNA, 19 nt, Artificial Sequence
  Chemically synthesized
uugcucgcaguuguagugc

SEQ ID NO: 2174 - RNA, 19 nt, Artificial Sequence
  Chemically synthesized
uuuguccaccaucuugugg

SEQ ID NO: 2175 - RNA, 19 nt, Artificial Sequence
  Chemically synthesized
uggguugccaucugugucc

SEQ ID NO: 2176 - RNA, 19 nt, Artificial Sequence
  Chemically synthesized
uuuugguuagcagcuuuuc

SEQ ID NO: 2177 - RNA, 19 nt, Artificial Sequence
  Chemically synthesized
uagugcucgcaguuguagu

SEQ ID NO: 2178 - RNA, 19 nt, Artificial Sequence
  Chemically synthesized
uaaguugaucuuggagugc

SEQ ID NO: 2179 - RNA, 19 nt, Artificial Sequence
  Chemically synthesized
uuuagcagcuuuucaaggc

SEQ ID NO: 2180 - RNA, 19 nt, Artificial Sequence
  Chemically synthesized
ugguauaggaccgagucac

SEQ ID NO: 2181 - RNA, 19 nt, Artificial Sequence
  Chemically synthesized
uaugggucaccuccaccac

SEQ ID NO: 2182 - RNA, 19 nt, Artificial Sequence
  Chemically synthesized
ucuauaacucgucucgcau

SEQ ID NO: 2183 - RNA, 19 nt, Artificial Sequence
  Chemically synthesized
uaauucuagcugggaaggu

SEQ ID NO: 2184 - RNA, 19 nt, Artificial Sequence
  Chemically synthesized
ugagugaauucuagcuggg

SEQ ID NO: 2185 - RNA, 19 nt, Artificial Sequence
  Chemically synthesized
uuccacguccuuggugacc

SEQ ID NO: 2186 - RNA, 19 nt, Artificial Sequence
  Chemically synthesized
uugugugcacccugaggcc

SEQ ID NO: 2187 - RNA, 19 nt, Artificial Sequence
  Chemically synthesized
uuccaaggcugguaccuca

SEQ ID NO: 2188 - RNA, 19 nt, Artificial Sequence
  Chemically synthesized
uuaggaccgagucaccaug

SEQ ID NO: 2189 - RNA, 19 nt, Artificial Sequence
  Chemically synthesized
ucaaggcugguaccucacc

SEQ ID NO: 2190 - RNA, 19 nt, Artificial Sequence
  Chemically synthesized
uagguuucuucaccucggc

SEQ ID NO: 2191 - RNA, 19 nt, Artificial Sequence
  Chemically synthesized
uacugagcuggguccguac

SEQ ID NO: 2192 - RNA, 19 nt, Artificial Sequence
  Chemically synthesized
uagguacagguccuucuug

SEQ ID NO: 2193 - RNA, 19 nt, Artificial Sequence
  Chemically synthesized
uguugaucuuggagugcuc

SEQ ID NO: 2194 - RNA, 19 nt, Artificial Sequence
  Chemically synthesized
uuguggcuugaagaacaug

SEQ ID NO: 2195 - RNA, 19 nt, Artificial Sequence
  Chemically synthesized
ucgcugagaagcaggaggg

SEQ ID NO: 2196 - RNA, 19 nt, Artificial Sequence
  Chemically synthesized
uguccuucuugccugacau

SEQ ID NO: 2197 - RNA, 19 nt, Artificial Sequence
  Chemically synthesized
uucgcggaaguugaucuug

SEQ ID NO: 2198 - RNA, 19 nt, Artificial Sequence
  Chemically synthesized
ucgguggcguggaacacgc

SEQ ID NO: 2199 - RNA, 19 nt, Artificial Sequence
  Chemically synthesized
ucucacugagcuggguccg

SEQ ID NO: 2200 - RNA, 19 nt, Artificial Sequence
  Chemically synthesized
uccugguacaagcugaagg

SEQ ID NO: 2201 - RNA, 19 nt, Artificial Sequence
  Chemically synthesized
uaugaugaggcuggagagc

SEQ ID NO: 2202 - RNA, 19 nt, Artificial Sequence
  Chemically synthesized
uagagcuugugggccaggg

SEQ ID NO: 2203 - RNA, 19 nt, Artificial Sequence
  Chemically synthesized
uuccuuggugaccucgggc

SEQ ID NO: 2204 - RNA, 19 nt, Artificial Sequence
  Chemically synthesized
ucaccaggauguucuccac

SEQ ID NO: 2205 - RNA, 19 nt, Artificial Sequence
  Chemically synthesized
uuggaguugcugagugagc

SEQ ID NO: 2206 - RNA, 19 nt, Artificial Sequence
  Chemically synthesized
ugcuugaagaacauggcgu

SEQ ID NO: 2207 - RNA, 19 nt, Artificial Sequence
  Chemically synthesized
uccaauagcacccaugugu

SEQ ID NO: 2208 - RNA, 19 nt, Artificial Sequence
  Chemically synthesized
ucgaagcucacugagcugg

SEQ ID NO: 2209 - RNA, 19 nt, Artificial Sequence
  Chemically synthesized
ugaagcucacugagcuggg

SEQ ID NO: 2210 - RNA, 19 nt, Artificial Sequence
  Chemically synthesized
uguggucgccuugccgccc

SEQ ID NO: 2211 - RNA, 19 nt, Artificial Sequence
  Chemically synthesized
ucauccugugugcacccug

SEQ ID NO: 2212 - RNA, 19 nt, Artificial Sequence
  Chemically synthesized
ucugcagguuucuucaccu

SEQ ID NO: 2213 - RNA, 19 nt, Artificial Sequence
  Chemically synthesized
uuuuuauaguugggagagg

SEQ ID NO: 2214 - RNA, 19 nt, Artificial Sequence
  Chemically synthesized
uagcuggguccguacaguc

SEQ ID NO: 2215 - RNA, 19 nt, Artificial Sequence
  Chemically synthesized
uccuccugggagcuccuuc

SEQ ID NO: 2216 - RNA, 19 nt, Artificial Sequence
  Chemically synthesized
uuucuugccugacaugcgu

SEQ ID NO: 2217 - RNA, 19 nt, Artificial Sequence
  Chemically synthesized
uacgguauaggaccgaguc

SEQ ID NO: 2218 - RNA, 19 nt, Artificial Sequence
  Chemically synthesized
ugugcucgcaguuguagug

SEQ ID NO: 2219 - RNA, 19 nt, Artificial Sequence
  Chemically synthesized
uuccgcagugccaggagcu

SEQ ID NO: 2220 - RNA, 19 nt, Artificial Sequence
  Chemically synthesized
ugcaucuugucacccuuag

SEQ ID NO: 2221 - RNA, 19 nt, Artificial Sequence
  Chemically synthesized
ugcucaauuuggucucaca

SEQ ID NO: 2222 - RNA, 19 nt, Artificial Sequence
  Chemically synthesized
ucaugcgugacaagucggc

SEQ ID NO: 2223 - RNA, 19 nt, Artificial Sequence
  Chemically synthesized
uaugccuccugccauccug

SEQ ID NO: 2224 - RNA, 19 nt, Artificial Sequence
  Chemically synthesized
uagucggccuuguucuugu

SEQ ID NO: 2225 - RNA, 19 nt, Artificial Sequence
  Chemically synthesized
ugaagcaggagggagcgca

SEQ ID NO: 2226 - RNA, 19 nt, Artificial Sequence
  Chemically synthesized
uugagcgcagcagcucgcc

SEQ ID NO: 2227 - RNA, 19 nt, Artificial Sequence
  Chemically synthesized
uaggccuguccggugcauc

SEQ ID NO: 2228 - RNA, 19 nt, Artificial Sequence
  Chemically synthesized
uuugccgcccagcgacacg

SEQ ID NO: 2229 - RNA, 19 nt, Artificial Sequence
  Chemically synthesized
uguugggagagguugggau

SEQ ID NO: 2230 - RNA, 19 nt, Artificial Sequence
  Chemically synthesized
ugguggucggcguagaaca

SEQ ID NO: 2231 - RNA, 19 nt, Artificial Sequence
  Chemically synthesized
uaagcugaaggccaggccg

SEQ ID NO: 2232 - RNA, 19 nt, Artificial Sequence
  Chemically synthesized
uacugccuuggccugcgac

SEQ ID NO: 2233 - RNA, 19 nt, Artificial Sequence
  Chemically synthesized
uagggcaggcagaaugacu

SEQ ID NO: 2234 - RNA, 19 nt, Artificial Sequence
  Chemically synthesized
ucggccaggucauucuggg

SEQ ID NO: 2235 - RNA, 19 nt, Artificial Sequence
  Chemically synthesized
ugguuguccaccaucuugu

SEQ ID NO: 2236 - RNA, 19 nt, Artificial Sequence
  Chemically synthesized
uaacauggcguugacuagc

SEQ ID NO: 2237 - RNA, 19 nt, Artificial Sequence
  Chemically synthesized
uacucaaaggcgguggcgu

SEQ ID NO: 2238 - RNA, 19 nt, Artificial Sequence
  Chemically synthesized
ugucgguggucugcgcggc

SEQ ID NO: 2239 - RNA, 19 nt, Artificial Sequence
  Chemically synthesized
uaggcgcccaaugaauagc

SEQ ID NO: 2240 - RNA, 19 nt, Artificial Sequence
  Chemically synthesized
uucagcgaagcucacugag

SEQ ID NO: 2241 - RNA, 19 nt, Artificial Sequence
  Chemically synthesized
uggcugguaccucaccucc

SEQ ID NO: 2242 - RNA, 19 nt, Artificial Sequence
  Chemically synthesized
ugcucagcacugccuuggc

SEQ ID NO: 2243 - RNA, 19 nt, Artificial Sequence
  Chemically synthesized
ugaugaugaggcuggagag

SEQ ID NO: 2244 - RNA, 19 nt, Artificial Sequence
  Chemically synthesized
uacugcggccaggucauuc

SEQ ID NO: 2245 - RNA, 19 nt, Artificial Sequence
  Chemically synthesized
uuauaggaccgagucacca

SEQ ID NO: 2246 - RNA, 19 nt, Artificial Sequence
  Chemically synthesized
ucaggugagaagguaccug

SEQ ID NO: 2247 - RNA, 19 nt, Artificial Sequence
  Chemically synthesized
uaaggcgguggcguggaac

SEQ ID NO: 2248 - RNA, 19 nt, Artificial Sequence
  Chemically synthesized
ucuggguccguacagucgg

SEQ ID NO: 2249 - RNA, 19 nt, Artificial Sequence
  Chemically synthesized
uuugccgucgguggucugc

SEQ ID NO: 2250 - RNA, 19 nt, Artificial Sequence
  Chemically synthesized
uuaacucgucucgcaucuu

SEQ ID NO: 2251 - RNA, 19 nt, Artificial Sequence
  Chemically synthesized
uaucuucagcugcucuuug

SEQ ID NO: 2252 - RNA, 19 nt, Artificial Sequence
  Chemically synthesized
ugcuuuuccuucucgucgu

SEQ ID NO: 2253 - RNA, 19 nt, Artificial Sequence
  Chemically synthesized
uccauguccaaguggagug

SEQ ID NO: 2254 - RNA, 19 nt, Artificial Sequence
  Chemically synthesized
ucccacucguugauggacu

SEQ ID NO: 2255 - RNA, 19 nt, Artificial Sequence
  Chemically synthesized
uugaaggccaggccggcgc

SEQ ID NO: 2256 - RNA, 19 nt, Artificial Sequence
  Chemically synthesized
uacgauuugcagcuuuucc

SEQ ID NO: 2257 - RNA, 19 nt, Artificial Sequence
  Chemically synthesized
ucacgcuccaacaaaaugu

SEQ ID NO: 2258 - RNA, 19 nt, Artificial Sequence
  Chemically synthesized
uucaccaugaagccacggu

SEQ ID NO: 2259 - RNA, 19 nt, Artificial Sequence
  Chemically synthesized
ucacuaggaagaugaaggg

SEQ ID NO: 2260 - RNA, 19 nt, Artificial Sequence
  Chemically synthesized
uaucuugugguggaauuuc

SEQ ID NO: 2261 - RNA, 19 nt, Artificial Sequence
  Chemically synthesized
ucagcaccuaguuuuauag

SEQ ID NO: 2262 - RNA, 19 nt, Artificial Sequence
  Chemically synthesized
uaggccggcgugcaccucc

SEQ ID NO: 2263 - RNA, 19 nt, Artificial Sequence
  Chemically synthesized
uagcacugccuuggccugc

SEQ ID NO: 2264 - RNA, 19 nt, Artificial Sequence
  Chemically synthesized
uuagcucaauuuggucuca

SEQ ID NO: 2265 - RNA, 19 nt, Artificial Sequence
  Chemically synthesized
uaggcagaaugacuauggc

SEQ ID NO: 2266 - RNA, 19 nt, Artificial Sequence
  Chemically synthesized
uccauccagaucuucagcu

SEQ ID NO: 2267 - RNA, 19 nt, Artificial Sequence
  Chemically synthesized
uccuugggcaaggagaugg

SEQ ID NO: 2268 - RNA, 19 nt, Artificial Sequence
  Chemically synthesized
uaggcaggcuugaucuggg

SEQ ID NO: 2269 - RNA, 19 nt, Artificial Sequence
  Chemically synthesized
ucaaggagauggcaacagc

SEQ ID NO: 2270 - RNA, 19 nt, Artificial Sequence
  Chemically synthesized
uacguccuuggugaccucg

SEQ ID NO: 2271 - RNA, 19 nt, Artificial Sequence
  Chemically synthesized
ucaccuaguuuuauaguug

SEQ ID NO: 2272 - RNA, 19 nt, Artificial Sequence
  Chemically synthesized
ugagauggcaacagccuuc

SEQ ID NO: 2273 - RNA, 19 nt, Artificial Sequence
  Chemically synthesized
ugggcucaacuucuccgca

SEQ ID NO: 2274 - RNA, 19 nt, Artificial Sequence
  Chemically synthesized
uacacccuugggcaaggag

SEQ ID NO: 2275 - RNA, 19 nt, Artificial Sequence
  Chemically synthesized
uaucugggacuuucagggc

SEQ ID NO: 2276 - RNA, 19 nt, Artificial Sequence
  Chemically synthesized
uaccuccaccacacccuug

SEQ ID NO: 2277 - RNA, 19 nt, Artificial Sequence
  Chemically synthesized
uagaucuucagcugcucuu

SEQ ID NO: 2278 - RNA, 19 nt, Artificial Sequence
  Chemically synthesized
ugccuucuucugcaucuuc

SEQ ID NO: 2279 - RNA, 19 nt, Artificial Sequence
  Chemically synthesized
ucaggauguggaguuuccg

SEQ ID NO: 2280 - RNA, 19 nt, Artificial Sequence
  Chemically synthesized
uaagaacauggcguugacu

SEQ ID NO: 2281 - RNA, 19 nt, Artificial Sequence
  Chemically synthesized
uagcuuuucaaggcgcucg

SEQ ID NO: 2282 - RNA, 19 nt, Artificial Sequence
  Chemically synthesized
uucaugacacccacgguau

SEQ ID NO: 2283 - RNA, 19 nt, Artificial Sequence
  Chemically synthesized
uaugacuauggcccagguc

SEQ ID NO: 2284 - RNA, 19 nt, Artificial Sequence
  Chemically synthesized
uuccuucuugccugacaug

SEQ ID NO: 2285 - RNA, 19 nt, Artificial Sequence
  Chemically synthesized
uccuauaacucgucucgca

SEQ ID NO: 2286 - RNA, 19 nt, Artificial Sequence
  Chemically synthesized
ucuuccaggucacguugcg

SEQ ID NO: 2287 - RNA, 19 nt, Artificial Sequence
  Chemically synthesized
uguuguagugcugcuugcu

SEQ ID NO: 2288 - RNA, 19 nt, Artificial Sequence
  Chemically synthesized
ucugagugagcgcagcagc

SEQ ID NO: 2289 - RNA, 19 nt, Artificial Sequence
  Chemically synthesized
ucuguccggugcaucauca

SEQ ID NO: 2290 - RNA, 19 nt, Artificial Sequence
  Chemically synthesized
uuuggauugauagcaacaa

SEQ ID NO: 2291 - RNA, 19 nt, Artificial Sequence
  Chemically synthesized
uguuagcagcuuuucaagg

SEQ ID NO: 2292 - RNA, 19 nt, Artificial Sequence
  Chemically synthesized
ugauguccuggucaaaggg

SEQ ID NO: 2293 - RNA, 19 nt, Artificial Sequence
  Chemically synthesized
uugcagguuucuucaccuc

SEQ ID NO: 2294 - RNA, 19 nt, Artificial Sequence
  Chemically synthesized
ucuccaccacacccuuggg

SEQ ID NO: 2295 - RNA, 19 nt, Artificial Sequence
  Chemically synthesized
ugcccaaugaauagcaggg

SEQ ID NO: 2296 - RNA, 19 nt, Artificial Sequence
  Chemically synthesized
uuugaucugggacuuucag

SEQ ID NO: 2297 - RNA, 19 nt, Artificial Sequence
  Chemically synthesized
uaucuccacgauuugcagc

SEQ ID NO: 2298 - RNA, 19 nt, Artificial Sequence
  Chemically synthesized
ucugauugaggcaggcuug

SEQ ID NO: 2299 - RNA, 19 nt, Artificial Sequence
  Chemically synthesized
uucgucgcgcagcugcucg

SEQ ID NO: 2300 - RNA, 19 nt, Artificial Sequence
  Chemically synthesized
uugcgugacaagucggccu

SEQ ID NO: 2301 - RNA, 19 nt, Artificial Sequence
  Chemically synthesized
uagugccaggagcugcugc

SEQ ID NO: 2302 - RNA, 19 nt, Artificial Sequence
  Chemically synthesized
uggcagaaugacuauggcc

SEQ ID NO: 2303 - RNA, 19 nt, Artificial Sequence
  Chemically synthesized
uuccgcucaggcacacggg

SEQ ID NO: 2304 - RNA, 19 nt, Artificial Sequence
  Chemically synthesized
ucauccagaucuucagcug

SEQ ID NO: 2305 - RNA, 19 nt, Artificial Sequence
  Chemically synthesized
uucaucccaguguggcuug

SEQ ID NO: 2306 - RNA, 19 nt, Artificial Sequence
  Chemically synthesized
uuccaaguggagugaauuc

SEQ ID NO: 2307 - RNA, 19 nt, Artificial Sequence
  Chemically synthesized
uuugacuagcagggcgccg

SEQ ID NO: 2308 - RNA, 19 nt, Artificial Sequence
  Chemically synthesized
uucggcugcccagcuucca

SEQ ID NO: 2309 - RNA, 19 nt, Artificial Sequence
  Chemically synthesized
ucgccguggucgccuugcc

SEQ ID NO: 2310 - RNA, 19 nt, Artificial Sequence
  Chemically synthesized
ucucaacuucuccgcagug

SEQ ID NO: 2311 - RNA, 19 nt, Artificial Sequence
  Chemically synthesized
ucuuuggaugccuccugcc

SEQ ID NO: 2312 - RNA, 19 nt, Artificial Sequence
  Chemically synthesized
uguauaggaccgagucacc

SEQ ID NO: 2313 - RNA, 19 nt, Artificial Sequence
  Chemically synthesized
uaagguaccuggcuauaaa

SEQ ID NO: 2314 - RNA, 19 nt, Artificial Sequence
  Chemically synthesized
uugguccuuggccauggcc

SEQ ID NO: 2315 - RNA, 19 nt, Artificial Sequence
  Chemically synthesized
ucuucccucccuaucuuug

SEQ ID NO: 2316 - RNA, 19 nt, Artificial Sequence
  Chemically synthesized
uuguuuuagugucagaaga

SEQ ID NO: 2317 - RNA, 19 nt, Artificial Sequence
  Chemically synthesized
uguguuuuagugucagaag

SEQ ID NO: 2318 - RNA, 19 nt, Artificial Sequence
  Chemically synthesized
uucgagaggcuccacguga

SEQ ID NO: 2319 - RNA, 19 nt, Artificial Sequence
  Chemically synthesized
uccacucguugauggacug

SEQ ID NO: 2320 - RNA, 19 nt, Artificial Sequence
  Chemically synthesized
uccuagcucaauuuggucu

SEQ ID NO: 2321 - RNA, 19 nt, Artificial Sequence
  Chemically synthesized
uucaggcacacgggaaccc

SEQ ID NO: 2322 - RNA, 19 nt, Artificial Sequence
  Chemically synthesized
uuucuuggauugauagcaa

SEQ ID NO: 2323 - RNA, 19 nt, Artificial Sequence
  Chemically synthesized
uaccaugaagccacgguug

SEQ ID NO: 2324 - RNA, 19 nt, Artificial Sequence
  Chemically synthesized
uugagcuggguccguacag

SEQ ID NO: 2325 - RNA, 19 nt, Artificial Sequence
  Chemically synthesized
uuagugcugcuugcugcug

SEQ ID NO: 2326 - RNA, 19 nt, Artificial Sequence
  Chemically synthesized
uagcugcugcggcugcagg

SEQ ID NO: 2327 - RNA, 19 nt, Artificial Sequence
  Chemically synthesized
ucugagguguuuuaguguc

SEQ ID NO: 2328 - RNA, 19 nt, Artificial Sequence
  Chemically synthesized
uuuggagugcucgcaguug

SEQ ID NO: 2329 - RNA, 19 nt, Artificial Sequence
  Chemically synthesized
ugcucaacuucuccgcagu

SEQ ID NO: 2330 - RNA, 19 nt, Artificial Sequence
  Chemically synthesized
ucguugacuagcagggcgc

SEQ ID NO: 2331 - RNA, 19 nt, Artificial Sequence
  Chemically synthesized
ugucggcugcccagcuucc

SEQ ID NO: 2332 - RNA, 19 nt, Artificial Sequence
  Chemically synthesized
ucaugugucucaggagccu

SEQ ID NO: 2333 - RNA, 19 nt, Artificial Sequence
  Chemically synthesized
uagcgcgcugcgcuugucg

SEQ ID NO: 2334 - RNA, 19 nt, Artificial Sequence
  Chemically synthesized
uaucagcgaagcucacuga

SEQ ID NO: 2335 - RNA, 19 nt, Artificial Sequence
  Chemically synthesized
ucugggagcuccuucucaa

SEQ ID NO: 2336 - RNA, 19 nt, Artificial Sequence
  Chemically synthesized
uucuuggagugcucgcagu

SEQ ID NO: 2337 - RNA, 19 nt, Artificial Sequence
  Chemically synthesized
uacgggugacaccaggaug

SEQ ID NO: 2338 - RNA, 19 nt, Artificial Sequence
  Chemically synthesized
ucugcuugcugcugcgcac

SEQ ID NO: 2339 - RNA, 19 nt, Artificial Sequence
  Chemically synthesized
ucucaaaggcgguggcgug

SEQ ID NO: 2340 - RNA, 19 nt, Artificial Sequence
  Chemically synthesized
uuuuucaaggcgcucgaga

SEQ ID NO: 2341 - RNA, 19 nt, Artificial Sequence
  Chemically synthesized
ucgaagucaucagcgaagc

SEQ ID NO: 2342 - RNA, 19 nt, Artificial Sequence
  Chemically synthesized
ucacccuugggcaaggaga

SEQ ID NO: 2343 - RNA, 19 nt, Artificial Sequence
  Chemically synthesized
ucacucguugauggacugc

SEQ ID NO: 2344 - RNA, 19 nt, Artificial Sequence
  Chemically synthesized
ucacgguuguccaccaucu

SEQ ID NO: 2345 - RNA, 19 nt, Artificial Sequence
  Chemically synthesized
uaugaauagcagggagccg

SEQ ID NO: 2346 - RNA, 19 nt, Artificial Sequence
  Chemically synthesized
uggcucagcaucaugguau

SEQ ID NO: 2347 - RNA, 19 nt, Artificial Sequence
  Chemically synthesized
ugugagaagguaccuggcu

SEQ ID NO: 2348 - RNA, 19 nt, Artificial Sequence
  Chemically synthesized
uuguggaguuuccgggcuc

SEQ ID NO: 2349 - RNA, 19 nt, Artificial Sequence
  Chemically synthesized
ucgcagugccaggagcugc

SEQ ID NO: 2350 - RNA, 19 nt, Artificial Sequence
  Chemically synthesized
uguccuuggugaccucggg

SEQ ID NO: 2351 - RNA, 19 nt, Artificial Sequence
  Chemically synthesized
uucaauggccucagucagg

SEQ ID NO: 2352 - RNA, 19 nt, Artificial Sequence
  Chemically synthesized
ugaguuuccgggcucagca

SEQ ID NO: 2353 - RNA, 19 nt, Artificial Sequence
  Chemically synthesized
ucuugggcaaggagauggc

SEQ ID NO: 2354 - RNA, 19 nt, Artificial Sequence
  Chemically synthesized
ucaguuguagugcugcuug

SEQ ID NO: 2355 - RNA, 19 nt, Artificial Sequence
  Chemically synthesized
ugcgcucagcacugccuug

SEQ ID NO: 2356 - RNA, 19 nt, Artificial Sequence
  Chemically synthesized
uuccaacaaaaugucauug

SEQ ID NO: 2357 - RNA, 19 nt, Artificial Sequence
  Chemically synthesized
uucaucagcgaagcucacu

SEQ ID NO: 2358 - RNA, 19 nt, Artificial Sequence
  Chemically synthesized
uuguccggugcaucaucau

SEQ ID NO: 2359 - RNA, 19 nt, Artificial Sequence
  Chemically synthesized
uagcccagccagguguuuc

SEQ ID NO: 2360 - RNA, 19 nt, Artificial Sequence
  Chemically synthesized
ucgcccaaugaauagcagg

SEQ ID NO: 2361 - RNA, 19 nt, Artificial Sequence
  Chemically synthesized
uaacucaaaggcgguggcg

SEQ ID NO: 2362 - RNA, 19 nt, Artificial Sequence
  Chemically synthesized
ucagaaggcgcugagaagc

SEQ ID NO: 2363 - RNA, 19 nt, Artificial Sequence
  Chemically synthesized
uuuuccgggcucagcauca

SEQ ID NO: 2364 - RNA, 19 nt, Artificial Sequence
  Chemically synthesized
ucucacugcggccagguca

SEQ ID NO: 2365 - RNA, 19 nt, Artificial Sequence
  Chemically synthesized
ucagccagguguuucugca

SEQ ID NO: 2366 - RNA, 19 nt, Artificial Sequence
  Chemically synthesized
ucucggcgcucagcacugc

SEQ ID NO: 2367 - RNA, 19 nt, Artificial Sequence
  Chemically synthesized
uaggucacguugcgcgccg

SEQ ID NO: 2368 - RNA, 19 nt, Artificial Sequence
  Chemically synthesized
uugcucggcgcucagcacu

SEQ ID NO: 2369 - RNA, 19 nt, Artificial Sequence
  Chemically synthesized
uguaguuguagaggccugu

SEQ ID NO: 2370 - RNA, 19 nt, Artificial Sequence
  Chemically synthesized
uuccucgucgcgcagcugc

SEQ ID NO: 2371 - RNA, 19 nt, Artificial Sequence
  Chemically synthesized
uugggagcuccuucucaau

SEQ ID NO: 2372 - RNA, 19 nt, Artificial Sequence
  Chemically synthesized
uccgucgguggucugcgcg

SEQ ID NO: 2373 - RNA, 19 nt, Artificial Sequence
  Chemically synthesized
uacgcuggccagguacagg

SEQ ID NO: 2374 - RNA, 19 nt, Artificial Sequence
  Chemically synthesized
ucugggaagguccgcucag

SEQ ID NO: 2375 - RNA, 19 nt, Artificial Sequence
  Chemically synthesized
uugguacaagcugaaggcc

SEQ ID NO: 2376 - RNA, 19 nt, Artificial Sequence
  Chemically synthesized
uagggagccgcuuugggug

SEQ ID NO: 2377 - RNA, 19 nt, Artificial Sequence
  Chemically synthesized
ucacugccugguccuuggc

SEQ ID NO: 2378 - RNA, 19 nt, Artificial Sequence
  Chemically synthesized
uuccugugugcacccugag

SEQ ID NO: 2379 - RNA, 19 nt, Artificial Sequence
  Chemically synthesized
uagugagcgcagcagcucg

SEQ ID NO: 2380 - RNA, 19 nt, Artificial Sequence
  Chemically synthesized
uccucagucaggcccagcc

SEQ ID NO: 2381 - RNA, 19 nt, Artificial Sequence
  Chemically synthesized
uugccaggagcugcugcgg

SEQ ID NO: 2382 - RNA, 19 nt, Artificial Sequence
  Chemically synthesized
uuauggcccaggucccaca

SEQ ID NO: 2383 - RNA, 19 nt, Artificial Sequence
  Chemically synthesized
uagccuucuucugcaucuu

SEQ ID NO: 2384 - RNA, 19 nt, Artificial Sequence
  Chemically synthesized
uucacguugcgcgccgugg

SEQ ID NO: 2385 - RNA, 19 nt, Artificial Sequence
  Chemically synthesized
uucucacaggugagaaggu

SEQ ID NO: 2386 - RNA, 19 nt, Artificial Sequence
  Chemically synthesized
ucggcugcagguuucuuca

SEQ ID NO: 2387 - RNA, 19 nt, Artificial Sequence
  Chemically synthesized
ucucgcaguuguagugcug

SEQ ID NO: 2388 - RNA, 19 nt, Artificial Sequence
  Chemically synthesized
ugcgcgcugcgcuugucgc

SEQ ID NO: 2389 - RNA, 19 nt, Artificial Sequence
  Chemically synthesized
ucaaguggagugaauucua

SEQ ID NO: 2390 - RNA, 19 nt, Artificial Sequence
  Chemically synthesized
ucccggucuguuuuuccac

SEQ ID NO: 2391 - RNA, 19 nt, Artificial Sequence
  Chemically synthesized
ugcucgagaggcuccacgu

SEQ ID NO: 2392 - RNA, 19 nt, Artificial Sequence
  Chemically synthesized
ucaggucacguugcgcgcc

SEQ ID NO: 2393 - RNA, 19 nt, Artificial Sequence
  Chemically synthesized
uugaagccacgguugucca

SEQ ID NO: 2394 - RNA, 19 nt, Artificial Sequence
  Chemically synthesized
ugaacauggcguugacuag

SEQ ID NO: 2395 - RNA, 19 nt, Artificial Sequence
  Chemically synthesized
ucugcggccaggucauucu

SEQ ID NO: 2396 - RNA, 19 nt, Artificial Sequence
  Chemically synthesized
uugagugagcgcagcagcu

SEQ ID NO: 2397 - RNA, 19 nt, Artificial Sequence
  Chemically synthesized
uggagagguugggauagag

SEQ ID NO: 2398 - RNA, 19 nt, Artificial Sequence
  Chemically synthesized
ugugagcgcagcagcucgc

SEQ ID NO: 2399 - RNA, 19 nt, Artificial Sequence
  Chemically synthesized
ugugcugcuugcugcugcg

SEQ ID NO: 2400 - RNA, 19 nt, Artificial Sequence
  Chemically synthesized
ugucaggcccagcccagcc

SEQ ID NO: 2401 - RNA, 19 nt, Artificial Sequence
  Chemically synthesized
uggaugaugaggcuggaga

SEQ ID NO: 2402 - RNA, 19 nt, Artificial Sequence
  Chemically synthesized
uuugaagaacauggcguug

SEQ ID NO: 2403 - RNA, 19 nt, Artificial Sequence
  Chemically synthesized
uaacuucuccgcagugcca

SEQ ID NO: 2404 - RNA, 19 nt, Artificial Sequence
  Chemically synthesized
uaucuguguccaacucaaa

SEQ ID NO: 2405 - RNA, 19 nt, Artificial Sequence
  Chemically synthesized
uagcgcagcagcucgccca

SEQ ID NO: 2406 - RNA, 19 nt, Artificial Sequence
  Chemically synthesized
ucugcucuuugguuagcag

SEQ ID NO: 2407 - RNA, 19 nt, Artificial Sequence
  Chemically synthesized
ucagcuuccaggucacguu

SEQ ID NO: 2408 - RNA, 19 nt, Artificial Sequence
  Chemically synthesized
ugcuccaacaaaaugucau

SEQ ID NO: 2409 - RNA, 19 nt, Artificial Sequence
  Chemically synthesized
ugccuuuggaugccuccug

SEQ ID NO: 2410 - RNA, 19 nt, Artificial Sequence
  Chemically synthesized
uacccuugggcaaggagau

SEQ ID NO: 2411 - RNA, 19 nt, Artificial Sequence
  Chemically synthesized
uguggaauuucucauccca

SEQ ID NO: 2412 - RNA, 19 nt, Artificial Sequence
  Chemically synthesized
uucuuugguuagcagcuuu

SEQ ID NO: 2413 - RNA, 19 nt, Artificial Sequence
  Chemically synthesized
uagccuuuggaugccuccu

SEQ ID NO: 2414 - RNA, 19 nt, Artificial Sequence
  Chemically synthesized
uuccaacucaaaggcggug

SEQ ID NO: 2415 - RNA, 19 nt, Artificial Sequence
  Chemically synthesized
uaccuaguuuuauaguugg

SEQ ID NO: 2416 - RNA, 19 nt, Artificial Sequence
  Chemically synthesized
ucagacacgaugcuucuug

SEQ ID NO: 2417 - RNA, 19 nt, Artificial Sequence
  Chemically synthesized
uuccagaucuucagcugcu

SEQ ID NO: 2418 - RNA, 19 nt, Artificial Sequence
  Chemically synthesized
uagaagcaggagggagcgc

SEQ ID NO: 2419 - RNA, 19 nt, Artificial Sequence
  Chemically synthesized
uacauggcguugacuagca

SEQ ID NO: 2420 - RNA, 19 nt, Artificial Sequence
  Chemically synthesized
uucgcgcagcugcucggcg

SEQ ID NO: 2421 - RNA, 19 nt, Artificial Sequence
  Chemically synthesized
ucgucgguggucugcgcgg

SEQ ID NO: 2422 - RNA, 19 nt, Artificial Sequence
  Chemically synthesized
uugagaagguaccuggcua

SEQ ID NO: 2423 - RNA, 19 nt, Artificial Sequence
  Chemically synthesized
uagaaggcgcugagaagca

SEQ ID NO: 2424 - RNA, 19 nt, Artificial Sequence
  Chemically synthesized
ucugagaagcaggagggag

SEQ ID NO: 2425 - RNA, 19 nt, Artificial Sequence
  Chemically synthesized
ugcacugccuuggccugcg

SEQ ID NO: 2426 - RNA, 19 nt, Artificial Sequence
  Chemically synthesized
uacgccguggucgccuugc

SEQ ID NO: 2427 - RNA, 19 nt, Artificial Sequence
  Chemically synthesized
uaggagcugcugcggcugc

SEQ ID NO: 2428 - RNA, 19 nt, Artificial Sequence
  Chemically synthesized
ucaccaaggacguggagca

SEQ ID NO: 2429 - RNA, 19 nt, Artificial Sequence
  Chemically synthesized
cagcgcgcugcaguccaua

SEQ ID NO: 2430 - RNA, 19 nt, Artificial Sequence
  Chemically synthesized
caucuacgggcgcgaggaa

SEQ ID NO: 2431 - RNA, 19 nt, Artificial Sequence
  Chemically synthesized
cuccagccucaucauccua

SEQ ID NO: 2432 - RNA, 19 nt, Artificial Sequence
  Chemically synthesized
gacaucuacgggcgcgaga

SEQ ID NO: 2433 - RNA, 19 nt, Artificial Sequence
  Chemically synthesized
cgugcgcagcagcaagcaa

SEQ ID NO: 2434 - RNA, 19 nt, Artificial Sequence
  Chemically synthesized
gucaccaaggacguggaga

SEQ ID NO: 2435 - RNA, 19 nt, Artificial Sequence
  Chemically synthesized
ccgcgacaagcgcagcgca

SEQ ID NO: 2436 - RNA, 19 nt, Artificial Sequence
  Chemically synthesized
gcgcagcgcgcugcaguca

SEQ ID NO: 2437 - RNA, 19 nt, Artificial Sequence
  Chemically synthesized
ggcccacaagcucuccaga

SEQ ID NO: 2438 - RNA, 19 nt, Artificial Sequence
  Chemically synthesized
caaggacguggagcgcaca

SEQ ID NO: 2439 - RNA, 19 nt, Artificial Sequence
  Chemically synthesized
agccucaucauccucauga

SEQ ID NO: 2440 - RNA, 19 nt, Artificial Sequence
  Chemically synthesized
ggugugguggaggugacca

SEQ ID NO: 2441 - RNA, 19 nt, Artificial Sequence
  Chemically synthesized
gcaagcugcccgaggucaa

SEQ ID NO: 2442 - RNA, 19 nt, Artificial Sequence
  Chemically synthesized
guggaggugacccaugaca

SEQ ID NO: 2443 - RNA, 19 nt, Artificial Sequence
  Chemically synthesized
cacaagaugguggacaaca

SEQ ID NO: 2444 - RNA, 19 nt, Artificial Sequence
  Chemically synthesized
gcgaggagcugcgcagcca

SEQ ID NO: 2445 - RNA, 19 nt, Artificial Sequence
  Chemically synthesized
uacuacgacgacgagaaga

SEQ ID NO: 2446 - RNA, 19 nt, Artificial Sequence
  Chemically synthesized
gaggugacccaugaccuga

SEQ ID NO: 2447 - RNA, 19 nt, Artificial Sequence
  Chemically synthesized
acuuccgcgacaagcgcaa

SEQ ID NO: 2448 - RNA, 19 nt, Artificial Sequence
  Chemically synthesized
gcccacaagcucuccagca

SEQ ID NO: 2449 - RNA, 19 nt, Artificial Sequence
  Chemically synthesized
gcgcagcagcaagcagcaa

SEQ ID NO: 2450 - RNA, 19 nt, Artificial Sequence
  Chemically synthesized
cgaggagcugcgcagccca

SEQ ID NO: 2451 - RNA, 19 nt, Artificial Sequence
  Chemically synthesized
aacgccauguucuucaaga

SEQ ID NO: 2452 - RNA, 19 nt, Artificial Sequence
  Chemically synthesized
gucaggcaagaaggaccua

SEQ ID NO: 2453 - RNA, 19 nt, Artificial Sequence
  Chemically synthesized
gccugggcgagcugcugca

SEQ ID NO: 2454 - RNA, 19 nt, Artificial Sequence
  Chemically synthesized
gaugaugcaccggacagga

SEQ ID NO: 2455 - RNA, 19 nt, Artificial Sequence
  Chemically synthesized
ggaccuguaccuggccaga

SEQ ID NO: 2456 - RNA, 19 nt, Artificial Sequence
  Chemically synthesized
gcgacgaggaggugcacga

SEQ ID NO: 2457 - RNA, 19 nt, Artificial Sequence
  Chemically synthesized
ugugguggaggugacccaa

SEQ ID NO: 2458 - RNA, 19 nt, Artificial Sequence
  Chemically synthesized
uucaagccacacugggaua

SEQ ID NO: 2459 - RNA, 19 nt, Artificial Sequence
  Chemically synthesized
caagaugguggacaaccga

SEQ ID NO: 2460 - RNA, 19 nt, Artificial Sequence
  Chemically synthesized
ucaacuuccgcgacaagca

SEQ ID NO: 2461 - RNA, 19 nt, Artificial Sequence
  Chemically synthesized
auucauugggcgccuggua

SEQ ID NO: 2462 - RNA, 19 nt, Artificial Sequence
  Chemically synthesized
cuccaagaucaacuuccga

SEQ ID NO: 2463 - RNA, 19 nt, Artificial Sequence
  Chemically synthesized
caggccauggccaaggaca

SEQ ID NO: 2464 - RNA, 19 nt, Artificial Sequence
  Chemically synthesized
guaccaggccauggccaaa

SEQ ID NO: 2465 - RNA, 19 nt, Artificial Sequence
  Chemically synthesized
ugucaggcaagaaggacca

SEQ ID NO: 2466 - RNA, 19 nt, Artificial Sequence
  Chemically synthesized
cuucgugcgcagcagcaaa

SEQ ID NO: 2467 - RNA, 19 nt, Artificial Sequence
  Chemically synthesized
caacuuccgcgacaagcga

SEQ ID NO: 2468 - RNA, 19 nt, Artificial Sequence
  Chemically synthesized
ccaccacaagaugguggaa

SEQ ID NO: 2469 - RNA, 19 nt, Artificial Sequence
  Chemically synthesized
gcgcgacgaggaggugcaa

SEQ ID NO: 2470 - RNA, 19 nt, Artificial Sequence
  Chemically synthesized
cuacaacugcgagcacuca

SEQ ID NO: 2471 - RNA, 19 nt, Artificial Sequence
  Chemically synthesized
uggaggugacccaugacca

SEQ ID NO: 2472 - RNA, 19 nt, Artificial Sequence
  Chemically synthesized
gaggucaccaaggacguga

SEQ ID NO: 2473 - RNA, 19 nt, Artificial Sequence
  Chemically synthesized
aagaaggaccuguaccuga

SEQ ID NO: 2474 - RNA, 19 nt, Artificial Sequence
  Chemically synthesized
gacaaccguggcuucauga

SEQ ID NO: 2475 - RNA, 19 nt, Artificial Sequence
  Chemically synthesized
accaggacaucuacgggca

SEQ ID NO: 2476 - RNA, 19 nt, Artificial Sequence
  Chemically synthesized
gcugcccgaggucaccaaa

SEQ ID NO: 2477 - RNA, 19 nt, Artificial Sequence
  Chemically synthesized
augcagaagaaggcuguua

SEQ ID NO: 2478 - RNA, 19 nt, Artificial Sequence
  Chemically synthesized
ggccugggcgagcugcuga

SEQ ID NO: 2479 - RNA, 19 nt, Artificial Sequence
  Chemically synthesized
gaugguggacaaccgugga

SEQ ID NO: 2480 - RNA, 19 nt, Artificial Sequence
  Chemically synthesized
cucccugcuauucauugga

SEQ ID NO: 2481 - RNA, 19 nt, Artificial Sequence
  Chemically synthesized
gaaggaccuguaccuggca

SEQ ID NO: 2482 - RNA, 19 nt, Artificial Sequence
  Chemically synthesized
ccaccgacggcaagcugca

SEQ ID NO: 2483 - RNA, 19 nt, Artificial Sequence
  Chemically synthesized
ugcuauucauugggcgcca

SEQ ID NO: 2484 - RNA, 19 nt, Artificial Sequence
  Chemically synthesized
auguucuucaagccacaca

SEQ ID NO: 2485 - RNA, 19 nt, Artificial Sequence
  Chemically synthesized
ccaggacaucuacgggcga

SEQ ID NO: 2486 - RNA, 19 nt, Artificial Sequence
  Chemically synthesized
gcgcgaggagcugcgcaga

SEQ ID NO: 2487 - RNA, 19 nt, Artificial Sequence
  Chemically synthesized
gagcagcugcgcgacgaga

SEQ ID NO: 2488 - RNA, 19 nt, Artificial Sequence
  Chemically synthesized
cuauucauugggcgccuga

SEQ ID NO: 2489 - RNA, 19 nt, Artificial Sequence
  Chemically synthesized
acaagcucuccagccucaa

SEQ ID NO: 2490 - RNA, 19 nt, Artificial Sequence
  Chemically synthesized
gcugaagaucuggauggga

SEQ ID NO: 2491 - RNA, 19 nt, Artificial Sequence
  Chemically synthesized
gaccaggacaucuacggga

SEQ ID NO: 2492 - RNA, 19 nt, Artificial Sequence
  Chemically synthesized
caagcgcagcgcgcugcaa

SEQ ID NO: 2493 - RNA, 19 nt, Artificial Sequence
  Chemically synthesized
ccauggccaaggaccagga

SEQ ID NO: 2494 - RNA, 19 nt, Artificial Sequence
  Chemically synthesized
caccaaggacguggagcga

SEQ ID NO: 2495 - RNA, 19 nt, Artificial Sequence
  Chemically synthesized
ccguggcuucauggugaca

SEQ ID NO: 2496 - RNA, 19 nt, Artificial Sequence
  Chemically synthesized
ugaccaggacaucuacgga

SEQ ID NO: 2497 - RNA, 19 nt, Artificial Sequence
  Chemically synthesized
agaccaccgacggcaagca

SEQ ID NO: 2498 - RNA, 19 nt, Artificial Sequence
  Chemically synthesized
gacaagcgcagcgcgcuga

SEQ ID NO: 2499 - RNA, 19 nt, Artificial Sequence
  Chemically synthesized
agaaacaccuggcugggca

SEQ ID NO: 2500 - RNA, 19 nt, Artificial Sequence
  Chemically synthesized
aagaugguggacaaccgua

SEQ ID NO: 2501 - RNA, 19 nt, Artificial Sequence
  Chemically synthesized
cagaccaccgacggcaaga

SEQ ID NO: 2502 - RNA, 19 nt, Artificial Sequence
  Chemically synthesized
aggaccuguaccuggccaa

SEQ ID NO: 2503 - RNA, 19 nt, Artificial Sequence
  Chemically synthesized
cugcuauucauugggcgca

SEQ ID NO: 2504 - RNA, 19 nt, Artificial Sequence
  Chemically synthesized
guccaucaacgagugggca

SEQ ID NO: 2505 - RNA, 19 nt, Artificial Sequence
  Chemically synthesized
ccaggccauggccaaggaa

SEQ ID NO: 2506 - RNA, 19 nt, Artificial Sequence
  Chemically synthesized
aagcagcacuacaacugca

SEQ ID NO: 2507 - RNA, 19 nt, Artificial Sequence
  Chemically synthesized
uguuccacgccaccgccua

SEQ ID NO: 2508 - RNA, 19 nt, Artificial Sequence
  Chemically synthesized
uacaacuacuacgacgaca

SEQ ID NO: 2509 - RNA, 19 nt, Artificial Sequence
  Chemically synthesized
ccucaucauccucaugcca

SEQ ID NO: 2510 - RNA, 19 nt, Artificial Sequence
  Chemically synthesized
ugguggacaaccguggcua

SEQ ID NO: 2511 - RNA, 19 nt, Artificial Sequence
  Chemically synthesized
gaccaccgacggcaagcua

SEQ ID NO: 2512 - RNA, 19 nt, Artificial Sequence
  Chemically synthesized
agcugcgcgacgaggagga

SEQ ID NO: 2513 - RNA, 19 nt, Artificial Sequence
  Chemically synthesized
cggcaagcugcccgaggua

SEQ ID NO: 2514 - RNA, 19 nt, Artificial Sequence
  Chemically synthesized
uggcccacaagcucuccaa

SEQ ID NO: 2515 - RNA, 19 nt, Artificial Sequence
  Chemically synthesized
cagcugcgcgacgaggaga

SEQ ID NO: 2516 - RNA, 19 nt, Artificial Sequence
  Chemically synthesized
cuuccgcgacaagcgcaga

SEQ ID NO: 2517 - RNA, 19 nt, Artificial Sequence
  Chemically synthesized
ugggccugacugaggccaa

SEQ ID NO: 2518 - RNA, 19 nt, Artificial Sequence
  Chemically synthesized
gcugcgcgacgaggaggua

SEQ ID NO: 2519 - RNA, 19 nt, Artificial Sequence
  Chemically synthesized
caggacaucuacgggcgca

SEQ ID NO: 2520 - RNA, 19 nt, Artificial Sequence
  Chemically synthesized
gccauggccaaggaccaga

SEQ ID NO: 2521 - RNA, 19 nt, Artificial Sequence
  Chemically synthesized
uccaagaucaacuuccgca

SEQ ID NO: 2522 - RNA, 19 nt, Artificial Sequence
  Chemically synthesized
accaccgacggcaagcuga

SEQ ID NO: 2523 - RNA, 19 nt, Artificial Sequence
  Chemically synthesized
aucuacgggcgcgaggaga

SEQ ID NO: 2524 - RNA, 19 nt, Artificial Sequence
  Chemically synthesized
cugcccgaggucaccaaga

SEQ ID NO: 2525 - RNA, 19 nt, Artificial Sequence
  Chemically synthesized
aucaacuuccgcgacaaga

SEQ ID NO: 2526 - RNA, 19 nt, Artificial Sequence
  Chemically synthesized
ucauugggcgccuggucca

SEQ ID NO: 2527 - RNA, 19 nt, Artificial Sequence
  Chemically synthesized
cauugggcgccugguccga

SEQ ID NO: 2528 - RNA, 19 nt, Artificial Sequence
  Chemically synthesized
guguuccacgccaccgcca

SEQ ID NO: 2529 - RNA, 19 nt, Artificial Sequence
  Chemically synthesized
augaugcaccggacaggca

SEQ ID NO: 2530 - RNA, 19 nt, Artificial Sequence
  Chemically synthesized
cgacgaggaggugcacgca

SEQ ID NO: 2531 - RNA, 19 nt, Artificial Sequence
  Chemically synthesized
cagaaacaccuggcuggga

SEQ ID NO: 2532 - RNA, 19 nt, Artificial Sequence
  Chemically synthesized
ugaugcaccggacaggcca

SEQ ID NO: 2533 - RNA, 19 nt, Artificial Sequence
  Chemically synthesized
aaggcuguugccaucucca

SEQ ID NO: 2534 - RNA, 19 nt, Artificial Sequence
  Chemically synthesized
augacuucgugcgcagcaa

SEQ ID NO: 2535 - RNA, 19 nt, Artificial Sequence
  Chemically synthesized
ucaggcaagaaggaccuga

SEQ ID NO: 2536 - RNA, 19 nt, Artificial Sequence
  Chemically synthesized
cucaucauccucaugccca

SEQ ID NO: 2537 - RNA, 19 nt, Artificial Sequence
  Chemically synthesized
cgcgacgaggaggugcaca

SEQ ID NO: 2538 - RNA, 19 nt, Artificial Sequence
  Chemically synthesized
acaaccguggcuucaugga

SEQ ID NO: 2539 - RNA, 19 nt, Artificial Sequence
  Chemically synthesized
uugaccaggacaucuacga

SEQ ID NO: 2540 - RNA, 19 nt, Artificial Sequence
  Chemically synthesized
caagcugcccgaggucaca

SEQ ID NO: 2541 - RNA, 19 nt, Artificial Sequence
  Chemically synthesized
ucccugcuauucauuggga

SEQ ID NO: 2542 - RNA, 19 nt, Artificial Sequence
  Chemically synthesized
uauucauugggcgccugga

SEQ ID NO: 2543 - RNA, 19 nt, Artificial Sequence
  Chemically synthesized
cugcgcgacgaggagguga

SEQ ID NO: 2544 - RNA, 19 nt, Artificial Sequence
  Chemically synthesized
cuacgggcgcgaggagcua

SEQ ID NO: 2545 - RNA, 19 nt, Artificial Sequence
  Chemically synthesized
cgcgaggagcugcgcagca

SEQ ID NO: 2546 - RNA, 19 nt, Artificial Sequence
  Chemically synthesized
acaccuggcugggcuggga

SEQ ID NO: 2547 - RNA, 19 nt, Artificial Sequence
  Chemically synthesized
ucuacgggcgcgaggagca

SEQ ID NO: 2548 - RNA, 19 nt, Artificial Sequence
  Chemically synthesized
uucuucaagccacacugga

SEQ ID NO: 2549 - RNA, 19 nt, Artificial Sequence
  Chemically synthesized
ccugggcgagcugcugcga

SEQ ID NO: 2550 - RNA, 19 nt, Artificial Sequence
  Chemically synthesized
aagaaggcuguugccauca

SEQ ID NO: 2551 - RNA, 19 nt, Artificial Sequence
  Chemically synthesized
cgacggcaagcugcccgaa

SEQ ID NO: 2552 - RNA, 19 nt, Artificial Sequence
  Chemically synthesized
gacggcaagcugcccgaga

SEQ ID NO: 2553 - RNA, 19 nt, Artificial Sequence
  Chemically synthesized
uucauugggcgccugguca

SEQ ID NO: 2554 - RNA, 19 nt, Artificial Sequence
  Chemically synthesized
aagcgcagcgcgcugcaga

SEQ ID NO: 2555 - RNA, 19 nt, Artificial Sequence
  Chemically synthesized
ccuggcccacaagcucuca

SEQ ID NO: 2556 - RNA, 19 nt, Artificial Sequence
  Chemically synthesized
acggcaagcugcccgagga

SEQ ID NO: 2557 - RNA, 19 nt, Artificial Sequence
  Chemically synthesized
uuugaccaggacaucuaca

SEQ ID NO: 2558 - RNA, 19 nt, Artificial Sequence
  Chemically synthesized
ugacuucgugcgcagcaga

SEQ ID NO: 2559 - RNA, 19 nt, Artificial Sequence
  Chemically synthesized
aaggacguggagcgcacga

SEQ ID NO: 2560 - RNA, 19 nt, Artificial Sequence
  Chemically synthesized
uccaucaacgagugggcca

SEQ ID NO: 2561 - RNA, 19 nt, Artificial Sequence
  Chemically synthesized
caccgacggcaagcugcca

SEQ ID NO: 2562 - RNA, 19 nt, Artificial Sequence
  Chemically synthesized
acgggcgcgaggagcugca

SEQ ID NO: 2563 - RNA, 19 nt, Artificial Sequence
  Chemically synthesized
uccgcgacaagcgcagcga

SEQ ID NO: 2564 - RNA, 19 nt, Artificial Sequence
  Chemically synthesized
uugggcgccugguccggca

SEQ ID NO: 2565 - RNA, 19 nt, Artificial Sequence
  Chemically synthesized
augguggacaaccguggca

SEQ ID NO: 2566 - RNA, 19 nt, Artificial Sequence
  Chemically synthesized
auugggcgccugguccgga

SEQ ID NO: 2567 - RNA, 19 nt, Artificial Sequence
  Chemically synthesized
uacgggcgcgaggagcuga

SEQ ID NO: 2568 - RNA, 19 nt, Artificial Sequence
  Chemically synthesized
augcaccggacaggccuca

SEQ ID NO: 2569 - RNA, 19 nt, Artificial Sequence
  Chemically synthesized
uuccaccacaagaugguga

SEQ ID NO: 2570 - RNA, 19 nt, Artificial Sequence
  Chemically synthesized
uuccgcgacaagcgcagca

SEQ ID NO: 2571 - RNA, 19 nt, Artificial Sequence
  Chemically synthesized
uaccaggccauggccaaga

SEQ ID NO: 2572 - RNA, 19 nt, Artificial Sequence
  Chemically synthesized
aaacaccuggcugggcuga

SEQ ID NO: 2573 - RNA, 19 nt, Artificial Sequence
  Chemically synthesized
accgacggcaagcugccca

SEQ ID NO: 2574 - RNA, 19 nt, Artificial Sequence
  Chemically synthesized
aacaccuggcugggcugga

SEQ ID NO: 2575 - RNA, 19 nt, Artificial Sequence
  Chemically synthesized
uucgugcgcagcagcaaga

SEQ ID NO: 2576 - RNA, 19 nt, Artificial Sequence
  Chemically synthesized
ugcuccacguccuugguga

SEQ ID NO: 2577 - RNA, 19 nt, Artificial Sequence
  Chemically synthesized
uauggacugcagcgcgcug

SEQ ID NO: 2578 - RNA, 19 nt, Artificial Sequence
  Chemically synthesized
uuccucgcgcccguagaug

SEQ ID NO: 2579 - RNA, 19 nt, Artificial Sequence
  Chemically synthesized
uaggaugaugaggcuggag

SEQ ID NO: 2580 - RNA, 19 nt, Artificial Sequence
  Chemically synthesized
ucucgcgcccguagauguc

SEQ ID NO: 2581 - RNA, 19 nt, Artificial Sequence
  Chemically synthesized
uugcuugcugcugcgcacg

SEQ ID NO: 2582 - RNA, 19 nt, Artificial Sequence
  Chemically synthesized
ucuccacguccuuggugac

SEQ ID NO: 2583 - RNA, 19 nt, Artificial Sequence
  Chemically synthesized
ugcgcugcgcuugucgcgg

SEQ ID NO: 2584 - RNA, 19 nt, Artificial Sequence
  Chemically synthesized
ugacugcagcgcgcugcgc

SEQ ID NO: 2585 - RNA, 19 nt, Artificial Sequence
  Chemically synthesized
ucuggagagcuugugggcc

SEQ ID NO: 2586 - RNA, 19 nt, Artificial Sequence
  Chemically synthesized
ugugcgcuccacguccuug

SEQ ID NO: 2587 - RNA, 19 nt, Artificial Sequence
  Chemically synthesized
ucaugaggaugaugaggcu

SEQ ID NO: 2588 - RNA, 19 nt, Artificial Sequence
  Chemically synthesized
uggucaccuccaccacacc

SEQ ID NO: 2589 - RNA, 19 nt, Artificial Sequence
  Chemically synthesized
uugaccucgggcagcuugc

SEQ ID NO: 2590 - RNA, 19 nt, Artificial Sequence
  Chemically synthesized
ugucaugggucaccuccac

SEQ ID NO: 2591 - RNA, 19 nt, Artificial Sequence
  Chemically synthesized
uguuguccaccaucuugug

SEQ ID NO: 2592 - RNA, 19 nt, Artificial Sequence
  Chemically synthesized
uggcugcgcagcuccucgc

SEQ ID NO: 2593 - RNA, 19 nt, Artificial Sequence
  Chemically synthesized
ucuucucgucgucguagua

SEQ ID NO: 2594 - RNA, 19 nt, Artificial Sequence
  Chemically synthesized
ucaggucaugggucaccuc

SEQ ID NO: 2595 - RNA, 19 nt, Artificial Sequence
  Chemically synthesized
uugcgcuugucgcggaagu

SEQ ID NO: 2596 - RNA, 19 nt, Artificial Sequence
  Chemically synthesized
ugcuggagagcuugugggc

SEQ ID NO: 2597 - RNA, 19 nt, Artificial Sequence
  Chemically synthesized
uugcugcuugcugcugcgc

SEQ ID NO: 2598 - RNA, 19 nt, Artificial Sequence
  Chemically synthesized
ugggcugcgcagcuccucg

SEQ ID NO: 2599 - RNA, 19 nt, Artificial Sequence
  Chemically synthesized
ucuugaagaacauggcguu

SEQ ID NO: 2600 - RNA, 19 nt, Artificial Sequence
  Chemically synthesized
uagguccuucuugccugac

SEQ ID NO: 2601 - RNA, 19 nt, Artificial Sequence
  Chemically synthesized
ugcagcagcucgcccaggc

SEQ ID NO: 2602 - RNA, 19 nt, Artificial Sequence
  Chemically synthesized
uccuguccggugcaucauc

SEQ ID NO: 2603 - RNA, 19 nt, Artificial Sequence
  Chemically synthesized
ucuggccagguacaggucc

SEQ ID NO: 2604 - RNA, 19 nt, Artificial Sequence
  Chemically synthesized
ucgugcaccuccucgucgc

SEQ ID NO: 2605 - RNA, 19 nt, Artificial Sequence
  Chemically synthesized
uugggucaccuccaccaca

SEQ ID NO: 2606 - RNA, 19 nt, Artificial Sequence
  Chemically synthesized
uaucccaguguggcuugaa

SEQ ID NO: 2607 - RNA, 19 nt, Artificial Sequence
  Chemically synthesized
ucgguuguccaccaucuug

SEQ ID NO: 2608 - RNA, 19 nt, Artificial Sequence
  Chemically synthesized
ugcuugucgcggaaguuga

SEQ ID NO: 2609 - RNA, 19 nt, Artificial Sequence
  Chemically synthesized
uaccaggcgcccaaugaau

SEQ ID NO: 2610 - RNA, 19 nt, Artificial Sequence
  Chemically synthesized
ucggaaguugaucuuggag

SEQ ID NO: 2611 - RNA, 19 nt, Artificial Sequence
  Chemically synthesized
uguccuuggccauggccug

SEQ ID NO: 2612 - RNA, 19 nt, Artificial Sequence
  Chemically synthesized
uuuggccauggccugguac

SEQ ID NO: 2613 - RNA, 19 nt, Artificial Sequence
  Chemically synthesized
ugguccuucuugccugaca

SEQ ID NO: 2614 - RNA, 19 nt, Artificial Sequence
  Chemically synthesized
uuugcugcugcgcacgaag

SEQ ID NO: 2615 - RNA, 19 nt, Artificial Sequence
  Chemically synthesized
ucgcuugucgcggaaguug

SEQ ID NO: 2616 - RNA, 19 nt, Artificial Sequence
  Chemically synthesized
uuccaccaucuuguggugg

SEQ ID NO: 2617 - RNA, 19 nt, Artificial Sequence
  Chemically synthesized
uugcaccuccucgucgcgc

SEQ ID NO: 2618 - RNA, 19 nt, Artificial Sequence
  Chemically synthesized
ugagugcucgcaguuguag

SEQ ID NO: 2619 - RNA, 19 nt, Artificial Sequence
  Chemically synthesized
uggucaugggucaccucca

SEQ ID NO: 2620 - RNA, 19 nt, Artificial Sequence
  Chemically synthesized
ucacguccuuggugaccuc

SEQ ID NO: 2621 - RNA, 19 nt, Artificial Sequence
  Chemically synthesized
ucagguacagguccuucuu

SEQ ID NO: 2622 - RNA, 19 nt, Artificial Sequence
  Chemically synthesized
ucaugaagccacgguuguc

SEQ ID NO: 2623 - RNA, 19 nt, Artificial Sequence
  Chemically synthesized
ugcccguagauguccuggu

SEQ ID NO: 2624 - RNA, 19 nt, Artificial Sequence
  Chemically synthesized
uuuggugaccucgggcagc

SEQ ID NO: 2625 - RNA, 19 nt, Artificial Sequence
  Chemically synthesized
uaacagccuucuucugcau

SEQ ID NO: 2626 - RNA, 19 nt, Artificial Sequence
  Chemically synthesized
ucagcagcucgcccaggcc

SEQ ID NO: 2627 - RNA, 19 nt, Artificial Sequence
  Chemically synthesized
uccacgguuguccaccauc

SEQ ID NO: 2628 - RNA, 19 nt, Artificial Sequence
  Chemically synthesized
uccaaugaauagcagggag

SEQ ID NO: 2629 - RNA, 19 nt, Artificial Sequence
  Chemically synthesized
ugccagguacagguccuuc

SEQ ID NO: 2630 - RNA, 19 nt, Artificial Sequence
  Chemically synthesized
ugcagcuugccgucggugg

SEQ ID NO: 2631 - RNA, 19 nt, Artificial Sequence
  Chemically synthesized
uggcgcccaaugaauagca

SEQ ID NO: 2632 - RNA, 19 nt, Artificial Sequence
  Chemically synthesized
uguguggcuugaagaacau

SEQ ID NO: 2633 - RNA, 19 nt, Artificial Sequence
  Chemically synthesized
ucgcccguagauguccugg

SEQ ID NO: 2634 - RNA, 19 nt, Artificial Sequence
  Chemically synthesized
ucugcgcagcuccucgcgc

SEQ ID NO: 2635 - RNA, 19 nt, Artificial Sequence
  Chemically synthesized
ucucgucgcgcagcugcuc

SEQ ID NO: 2636 - RNA, 19 nt, Artificial Sequence
  Chemically synthesized
ucaggcgcccaaugaauag

SEQ ID NO: 2637 - RNA, 19 nt, Artificial Sequence
  Chemically synthesized
uugaggcuggagagcuugu

SEQ ID NO: 2638 - RNA, 19 nt, Artificial Sequence
  Chemically synthesized
ucccauccagaucuucagc

SEQ ID NO: 2639 - RNA, 19 nt, Artificial Sequence
  Chemically synthesized
ucccguagauguccugguc

SEQ ID NO: 2640 - RNA, 19 nt, Artificial Sequence
  Chemically synthesized
uugcagcgcgcugcgcuug

SEQ ID NO: 2641 - RNA, 19 nt, Artificial Sequence
  Chemically synthesized
uccugguccuuggccaugg

SEQ ID NO: 2642 - RNA, 19 nt, Artificial Sequence
  Chemically synthesized
ucgcuccacguccuuggug

SEQ ID NO: 2643 - RNA, 19 nt, Artificial Sequence
  Chemically synthesized
ugucaccaugaagccacgg

SEQ ID NO: 2644 - RNA, 19 nt, Artificial Sequence
  Chemically synthesized
uccguagauguccugguca

SEQ ID NO: 2645 - RNA, 19 nt, Artificial Sequence
  Chemically synthesized
ugcuugccgucgguggucu

SEQ ID NO: 2646 - RNA, 19 nt, Artificial Sequence
  Chemically synthesized
ucagcgcgcugcgcuuguc

SEQ ID NO: 2647 - RNA, 19 nt, Artificial Sequence
  Chemically synthesized
ugcccagccagguguuucu

SEQ ID NO: 2648 - RNA, 19 nt, Artificial Sequence
  Chemically synthesized
uacgguuguccaccaucuu

SEQ ID NO: 2649 - RNA, 19 nt, Artificial Sequence
  Chemically synthesized
ucuugccgucgguggucug

SEQ ID NO: 2650 - RNA, 19 nt, Artificial Sequence
  Chemically synthesized
uuggccagguacagguccu

SEQ ID NO: 2651 - RNA, 19 nt, Artificial Sequence
  Chemically synthesized
ugcgcccaaugaauagcag

SEQ ID NO: 2652 - RNA, 19 nt, Artificial Sequence
  Chemically synthesized
ugcccacucguugauggac

SEQ ID NO: 2653 - RNA, 19 nt, Artificial Sequence
  Chemically synthesized
uuccuuggccauggccugg

SEQ ID NO: 2654 - RNA, 19 nt, Artificial Sequence
  Chemically synthesized
ugcaguuguagugcugcuu

SEQ ID NO: 2655 - RNA, 19 nt, Artificial Sequence
  Chemically synthesized
uaggcgguggcguggaaca

SEQ ID NO: 2656 - RNA, 19 nt, Artificial Sequence
  Chemically synthesized
ugucgucguaguaguugua

SEQ ID NO: 2657 - RNA, 19 nt, Artificial Sequence
  Chemically synthesized
uggcaugaggaugaugagg

SEQ ID NO: 2658 - RNA, 19 nt, Artificial Sequence
  Chemically synthesized
uagccacgguuguccacca

SEQ ID NO: 2659 - RNA, 19 nt, Artificial Sequence
  Chemically synthesized
uagcuugccgucggugguc

SEQ ID NO: 2660 - RNA, 19 nt, Artificial Sequence
  Chemically synthesized
uccuccucgucgcgcagcu

SEQ ID NO: 2661 - RNA, 19 nt, Artificial Sequence
  Chemically synthesized
uaccucgggcagcuugccg

SEQ ID NO: 2662 - RNA, 19 nt, Artificial Sequence
  Chemically synthesized
uuggagagcuugugggcca

SEQ ID NO: 2663 - RNA, 19 nt, Artificial Sequence
  Chemically synthesized
ucuccucgucgcgcagcug

SEQ ID NO: 2664 - RNA, 19 nt, Artificial Sequence
  Chemically synthesized
ucugcgcuugucgcggaag

SEQ ID NO: 2665 - RNA, 19 nt, Artificial Sequence
  Chemically synthesized
uuggccucagucaggccca

SEQ ID NO: 2666 - RNA, 19 nt, Artificial Sequence
  Chemically synthesized
uaccuccucgucgcgcagc

SEQ ID NO: 2667 - RNA, 19 nt, Artificial Sequence
  Chemically synthesized
ugcgcccguagauguccug

SEQ ID NO: 2668 - RNA, 19 nt, Artificial Sequence
  Chemically synthesized
ucugguccuuggccauggc

SEQ ID NO: 2669 - RNA, 19 nt, Artificial Sequence
  Chemically synthesized
ugcggaaguugaucuugga

SEQ ID NO: 2670 - RNA, 19 nt, Artificial Sequence
  Chemically synthesized
ucagcuugccgucgguggu

SEQ ID NO: 2671 - RNA, 19 nt, Artificial Sequence
  Chemically synthesized
ucuccucgcgcccguagau

SEQ ID NO: 2672 - RNA, 19 nt, Artificial Sequence
  Chemically synthesized
ucuuggugaccucgggcag

SEQ ID NO: 2673 - RNA, 19 nt, Artificial Sequence
  Chemically synthesized
ucuugucgcggaaguugau

SEQ ID NO: 2674 - RNA, 19 nt, Artificial Sequence
  Chemically synthesized
uggaccaggcgcccaauga

SEQ ID NO: 2675 - RNA, 19 nt, Artificial Sequence
  Chemically synthesized
ucggaccaggcgcccaaug

SEQ ID NO: 2676 - RNA, 19 nt, Artificial Sequence
  Chemically synthesized
uggcgguggcguggaacac

SEQ ID NO: 2677 - RNA, 19 nt, Artificial Sequence
  Chemically synthesized
ugccuguccggugcaucau

SEQ ID NO: 2678 - RNA, 19 nt, Artificial Sequence
  Chemically synthesized
ugcgugcaccuccucgucg

SEQ ID NO: 2679 - RNA, 19 nt, Artificial Sequence
  Chemically synthesized
ucccagccagguguuucug

SEQ ID NO: 2680 - RNA, 19 nt, Artificial Sequence
  Chemically synthesized
uggccuguccggugcauca

SEQ ID NO: 2681 - RNA, 19 nt, Artificial Sequence
  Chemically synthesized
uggagauggcaacagccuu

SEQ ID NO: 2682 - RNA, 19 nt, Artificial Sequence
  Chemically synthesized
uugcugcgcacgaagucau

SEQ ID NO: 2683 - RNA, 19 nt, Artificial Sequence
  Chemically synthesized
ucagguccuucuugccuga

SEQ ID NO: 2684 - RNA, 19 nt, Artificial Sequence
  Chemically synthesized
ugggcaugaggaugaugag

SEQ ID NO: 2685 - RNA, 19 nt, Artificial Sequence
  Chemically synthesized
ugugcaccuccucgucgcg

SEQ ID NO: 2686 - RNA, 19 nt, Artificial Sequence
  Chemically synthesized
uccaugaagccacgguugu

SEQ ID NO: 2687 - RNA, 19 nt, Artificial Sequence
  Chemically synthesized
ucguagauguccuggucaa

SEQ ID NO: 2688 - RNA, 19 nt, Artificial Sequence
  Chemically synthesized
ugugaccucgggcagcuug

SEQ ID NO: 2689 - RNA, 19 nt, Artificial Sequence
  Chemically synthesized
ucccaaugaauagcaggga

SEQ ID NO: 2690 - RNA, 19 nt, Artificial Sequence
  Chemically synthesized
uccaggcgcccaaugaaua

SEQ ID NO: 2691 - RNA, 19 nt, Artificial Sequence
  Chemically synthesized
ucaccuccucgucgcgcag

SEQ ID NO: 2692 - RNA, 19 nt, Artificial Sequence
  Chemically synthesized
uagcuccucgcgcccguag

SEQ ID NO: 2693 - RNA, 19 nt, Artificial Sequence
  Chemically synthesized
ugcugcgcagcuccucgcg

SEQ ID NO: 2694 - RNA, 19 nt, Artificial Sequence
  Chemically synthesized
ucccagcccagccaggugu

SEQ ID NO: 2695 - RNA, 19 nt, Artificial Sequence
  Chemically synthesized
ugcuccucgcgcccguaga

SEQ ID NO: 2696 - RNA, 19 nt, Artificial Sequence
  Chemically synthesized
uccaguguggcuugaagaa

SEQ ID NO: 2697 - RNA, 19 nt, Artificial Sequence
  Chemically synthesized
ucgcagcagcucgcccagg

SEQ ID NO: 2698 - RNA, 19 nt, Artificial Sequence
  Chemically synthesized
ugauggcaacagccuucuu

SEQ ID NO: 2699 - RNA, 19 nt, Artificial Sequence
  Chemically synthesized
uucgggcagcuugccgucg

SEQ ID NO: 2700 - RNA, 19 nt, Artificial Sequence
  Chemically synthesized
ucucgggcagcuugccguc

SEQ ID NO: 2701 - RNA, 19 nt, Artificial Sequence
  Chemically synthesized
ugaccaggcgcccaaugaa

SEQ ID NO: 2702 - RNA, 19 nt, Artificial Sequence
  Chemically synthesized
ucugcagcgcgcugcgcuu

SEQ ID NO: 2703 - RNA, 19 nt, Artificial Sequence
  Chemically synthesized
ugagagcuugugggccagg

SEQ ID NO: 2704 - RNA, 19 nt, Artificial Sequence
  Chemically synthesized
uccucgggcagcuugccgu

SEQ ID NO: 2705 - RNA, 19 nt, Artificial Sequence
  Chemically synthesized
uguagauguccuggucaaa

SEQ ID NO: 2706 - RNA, 19 nt, Artificial Sequence
  Chemically synthesized
ucugcugcgcacgaaguca

SEQ ID NO: 2707 - RNA, 19 nt, Artificial Sequence
  Chemically synthesized
ucgugcgcuccacguccuu

SEQ ID NO: 2708 - RNA, 19 nt, Artificial Sequence
  Chemically synthesized
uggcccacucguugaugga

SEQ ID NO: 2709 - RNA, 19 nt, Artificial Sequence
  Chemically synthesized
uggcagcuugccgucggug

SEQ ID NO: 2710 - RNA, 19 nt, Artificial Sequence
  Chemically synthesized
ugcagcuccucgcgcccgu

SEQ ID NO: 2711 - RNA, 19 nt, Artificial Sequence
  Chemically synthesized
ucgcugcgcuugucgcgga

SEQ ID NO: 2712 - RNA, 19 nt, Artificial Sequence
  Chemically synthesized
ugccggaccaggcgcccaa

SEQ ID NO: 2713 - RNA, 19 nt, Artificial Sequence
  Chemically synthesized
ugccacgguuguccaccau

SEQ ID NO: 2714 - RNA, 19 nt, Artificial Sequence
  Chemically synthesized
uccggaccaggcgcccaau

SEQ ID NO: 2715 - RNA, 19 nt, Artificial Sequence
  Chemically synthesized
ucagcuccucgcgcccgua

SEQ ID NO: 2716 - RNA, 19 nt, Artificial Sequence
  Chemically synthesized
ugaggccuguccggugcau

SEQ ID NO: 2717 - RNA, 19 nt, Artificial Sequence
  Chemically synthesized
ucaccaucuugugguggaa

SEQ ID NO: 2718 - RNA, 19 nt, Artificial Sequence
  Chemically synthesized
ugcugcgcuugucgcggaa

SEQ ID NO: 2719 - RNA, 19 nt, Artificial Sequence
  Chemically synthesized
ucuuggccauggccuggua

SEQ ID NO: 2720 - RNA, 19 nt, Artificial Sequence
  Chemically synthesized
ucagcccagccagguguuu

SEQ ID NO: 2721 - RNA, 19 nt, Artificial Sequence
  Chemically synthesized
ugggcagcuugccgucggu

SEQ ID NO: 2722 - RNA, 19 nt, Artificial Sequence
  Chemically synthesized
uccagcccagccagguguu

SEQ ID NO: 2723 - RNA, 19 nt, Artificial Sequence
  Chemically synthesized
ucuugcugcugcgcacgaa

SEQ ID NO: 2724 - DNA, 33 bp, Artificial Sequence
  Chemically synthesized
ctcgaggagacacatgggtgctatagcggccgc

SEQ ID NO: 2725 - DNA, 26 bp, Artificial Sequence
  Chemically synthesized
tcgaggagacacatgggtgctatagc

SEQ ID NO: 2726 - DNA, 26 bp, Artificial Sequence
  Chemically synthesized
ggccgctatagcacccatgtgtctcc

SEQ ID NO: 2727 - DNA, 34 bp, Artificial Sequence
  Chemically synthesized
ctcgagtctcaaacgttgtgctatcgcggccgca

SEQ ID NO: 2728 - DNA, 19 bp, Artificial Sequence
  Chemically synthesized
ctctgtgtacccacgatat

SEQ ID NO: 2729 - DNA, 33 bp, Artificial Sequence
  Chemically synthesized
ctcgagtatagcacccatgtgtctcgcggccgc

SEQ ID NO: 2730 - DNA, 33 bp, Artificial Sequence
  Chemically synthesized
ctcgaggcgatacaaactgtgtctagcggccgc

SEQ ID NO: 2731 - DNA, 19 bp, Artificial Sequence
  Chemically synthesized
atatcgtgggtacacagag

SEQ ID NO: 2732 - DNA, 79 bp, Artificial Sequence
  Chemically synthesized
ctcgagtctcaaacgttgtgctatcttcctctcaaacgttgtgctatcttcctctcaaacgttgtgctatcgcggccgc

SEQ ID NO: 2733 - DNA, 79 bp, Artificial Sequence
  Chemically synthesized
ctcgaggcgatacaaactgtgtctattccgcgatacaaactgtgtctattccgcgatacaaactgtgtctagcggccgc

SEQ ID NO: 2734 - DNA, 26 bp, Artificial Sequence
  Chemically synthesized
ggccgccggacaggcctctacaacac

SEQ ID NO: 2735 - DNA, 26 bp, Artificial Sequence
  Chemically synthesized
tcgagtgttgtagaggcctgtccggc

SEQ ID NO: 2736 - DNA, 26 bp, Artificial Sequence
  Chemically synthesized
ggccgctgttgtagaggcctgtccgc

SEQ ID NO: 2737 - DNA, 26 bp, Artificial Sequence
  Chemically synthesized
tcgagcggacaggcctctacaacagc

SEQ ID NO: 2738 - DNA, 26 bp, Artificial Sequence
  Chemically synthesized
ggccgcaggacaggaagagcaccacc

SEQ ID NO: 2739 - DNA, 26 bp, Artificial Sequence
  Chemically synthesized
tcgaggtggtgctcttcctgtcctgc

SEQ ID NO: 2740 - DNA, 26 bp, Artificial Sequence
  Chemically synthesized
ggccgcggttgtagcttaagggaatc

SEQ ID NO: 2741 - DNA, 26 bp, Artificial Sequence
  Chemically synthesized
tcgagattcccttaagctacaaccgc

SEQ ID NO: 2742 - DNA, 72 bp, Artificial Sequence
  Chemically synthesized
ggccgcaggacaggaagagcaccacggaaaggacaggaagagcaccacggaaaggacaggaagagcaccacc

SEQ ID NO: 2743 - DNA, 72 bp, Artificial Sequence
  Chemically synthesized
tcgaggtggtgctcttcctgtcctttccgtggtgctcttcctgtcctttccgtggtgctcttcctgtcctgc

SEQ ID NO: 2744 - DNA, 72 bp, Artificial Sequence
  Chemically synthesized
ggccgcggttgtagcttaagggaatggaaggttgtagcttaagggaatggaaggttgtagcttaagggaatc

SEQ ID NO: 2745 - DNA, 72 bp, Artificial Sequence
  Chemically synthesized
tcgagattcccttaagctacaaccttccattcccttaagctacaaccttccattcccttaagctacaaccgc

SEQ ID NO: 2746 - DNA, 26 bp, Artificial Sequence
  Chemically synthesized
ggccgccggacaggcctctacaactc

SEQ ID NO: 2747 - DNA, 26 bp, Artificial Sequence
  Chemically synthesized
tcgagagttgtagaggcctgtccggc

SEQ ID NO: 2748 - DNA, 26 bp, Artificial Sequence
  Chemically synthesized
ggccgcagttgtagaggcctgtccgc

SEQ ID NO: 2749 - DNA, 26 bp, Artificial Sequence
  Chemically synthesized
tcgagcggacaggcctctacaactgc

SEQ ID NO: 2750 - DNA, 26 bp, Artificial Sequence
  Chemically synthesized
ggccgcgagacacatgggtgctatac

SEQ ID NO: 2751 - DNA, 26 bp, Artificial Sequence
  Chemically synthesized
tcgagtatagcacccatgtgtctcgc

SEQ ID NO: 2752 - DNA, 26 bp, Artificial Sequence
  Chemically synthesized
ggccgctatagcacccatgtgtctcc

SEQ ID NO: 2753 - DNA, 26 bp, Artificial Sequence
  Chemically synthesized
tcgaggagacacatgggtgctatagc

SEQ ID NO: 2754 - DNA, 26 bp, Artificial Sequence
  Chemically synthesized
ggccgctagacacagtttgtatcgcc

SEQ ID NO: 2755 - DNA, 26 bp, Artificial Sequence
  Chemically synthesized
tcgaggcgatacaaactgtgtctagc

SEQ ID NO: 2756 - DNA, 26 bp, Artificial Sequence
  Chemically synthesized
ggccgcgatagcacaacgtttgagac

SEQ ID NO: 2757 - DNA, 26 bp, Artificial Sequence
  Chemically synthesized
tcgagtctcaaacgttgtgctatcgc

SEQ ID NO: 2758 - DNA, 72 bp, Artificial Sequence
  Chemically synthesized
ggccgctagacacagtttgtatcgcggaatagacacagtttgtatcgcggaatagacacagtttgtatcgcc

SEQ ID NO: 2759 - DNA, 72 bp, Artificial Sequence
  Chemically synthesized
tcgaggcgatacaaactgtgtctattccgcgatacaaactgtgtctattccgcgatacaaactgtgtctagc

SEQ ID NO: 2760 - DNA, 72 bp, Artificial Sequence
  Chemically synthesized
ggccgcgatagcacaacgtttgagaggaagatagcacaacgtttgagaggaagatagcacaacgtttgagac

SEQ ID NO: 2761 - DNA, 72 bp, Artificial Sequence
  Chemically synthesized
tcgagtctcaaacgttgtgctatcttcctctcaaacgttgtgctatcttcctctcaaacgttgtgctatcgc

SEQ ID NO: 2762 - DNA, 26 bp, Artificial Sequence
  Chemically synthesized
ggccgcgagacacatgggtgctattc

SEQ ID NO: 2763 - DNA, 26 bp, Artificial Sequence
  Chemically synthesized
tcgagaatagcacccatgtgtctcgc

SEQ ID NO: 2764 - DNA, 26 bp, Artificial Sequence
  Chemically synthesized
ggccgcaatagcacccatgtgtctcc

SEQ ID NO: 2765 - DNA, 26 bp, Artificial Sequence
  Chemically synthesized
tcgaggagacacatgggtgctattgc

SEQ ID NO: 2766 - DNA, 26 bp, Artificial Sequence
  Chemically synthesized
ggccgcacaagatgcgagacgagtac

SEQ ID NO: 2767 - DNA, 26 bp, Artificial Sequence
  Chemically synthesized
tcgagtactcgtctcgcatcttgtgc

SEQ ID NO: 2768 - DNA, 26 bp, Artificial Sequence
  Chemically synthesized
ggccgctactcgtctcgcatcttgtc

SEQ ID NO: 2769 - DNA, 26 bp, Artificial Sequence
  Chemically synthesized
tcgagacaagatgcgagacgagtagc

SEQ ID NO: 2770 - DNA, 26 bp, Artificial Sequence
  Chemically synthesized
ggccgcccaagatgatctaatctgcc

SEQ ID NO: 2771 - DNA, 26 bp, Artificial Sequence
  Chemically synthesized
tcgaggcagattagatcatcttgggc

SEQ ID NO: 2772 - DNA, 26 bp, Artificial Sequence
  Chemically synthesized
ggccgcgactcgtcgatactaggtgc

SEQ ID NO: 2773 - DNA, 26 bp, Artificial Sequence
  Chemically synthesized
tcgagcacctagtatcgacgagtcgc

SEQ ID NO: 2774 - DNA, 72 bp, Artificial Sequence
  Chemically synthesized
tcgaggcagattagatcatcttggttccgcagattagatcatcttggttccgcagattagatcatcttgggc

SEQ ID NO: 2775 - DNA, 72 bp, Artificial Sequence
  Chemically synthesized
ggccgcccaagatgatctaatctgcggaaccaagatgatctaatctgcggaaccaagatgatctaatctgcc

SEQ ID NO: 2776 - DNA, 72 bp, Artificial Sequence
  Chemically synthesized
ggccgcgactcgtcgatactaggtgggaagactcgtcgatactaggtgggaagactcgtcgatactaggtgc

SEQ ID NO: 2777 - DNA, 72 bp, Artificial Sequence
  Chemically synthesized
tcgagcacctagtatcgacgagtcttcccacctagtatcgacgagtcttcccacctagtatcgacgagtcgc

SEQ ID NO: 2778 - DNA, 26 bp, Artificial Sequence
  Chemically synthesized
ggccgcacaagatgcgagacgagttc

SEQ ID NO: 2779 - DNA, 26 bp, Artificial Sequence
  Chemically synthesized
tcgagaactcgtctcgcatcttgtgc

SEQ ID NO: 2780 - DNA, 26 bp, Artificial Sequence
  Chemically synthesized
ggccgcaactcgtctcgcatcttgtc

SEQ ID NO: 2781 - DNA, 26 bp, Artificial Sequence
  Chemically synthesized
tcgagacaagatgcgagacgagttgc

SEQ ID NO: 2782 - DNA, 26 bp, Artificial Sequence
  Chemically synthesized
ggccgcactccaagatcaacttcctc

SEQ ID NO: 2783 - DNA, 26 bp, Artificial Sequence
  Chemically synthesized
tcgagaggaagttgatcttggagtgc

SEQ ID NO: 2784 - DNA, 26 bp, Artificial Sequence
  Chemically synthesized
ggccgcaggaagttgatcttggagtc

SEQ ID NO: 2785 - DNA, 26 bp, Artificial Sequence
  Chemically synthesized
tcgagactccaagatcaacttcctgc

SEQ ID NO: 2786 - DNA, 26 bp, Artificial Sequence
  Chemically synthesized
ggccgccctccaagcgaccatgaagc

SEQ ID NO: 2787 - DNA, 26 bp, Artificial Sequence
  Chemically synthesized
tcgagcttcatggtcgcttggagggc

SEQ ID NO: 2788 - DNA, 26 bp, Artificial Sequence
  Chemically synthesized
ggccgccggaagtttcgatgttctgc

SEQ ID NO: 2789 - DNA, 26 bp, Artificial Sequence
  Chemically synthesized
tcgagcagaacatcgaaacttccggc

SEQ ID NO: 2790 - DNA, 72 bp, Artificial Sequence
  Chemically synthesized
ggccgccctccaagcgaccatgaagggaacctccaagcgaccatgaagggaacctccaagcgaccatgaagc

SEQ ID NO: 2791 - DNA, 72 bp, Artificial Sequence
  Chemically synthesized
tcgagcttcatggtcgcttggaggttcccttcatggtcgcttggaggttcccttcatggtcgcttggagggc

SEQ ID NO: 2792 - DNA, 72 bp, Artificial Sequence
  Chemically synthesized
ggccgccggaagtttcgatgttctgggaacggaagtttcgatgttctgggaacggaagtttcgatgttctgc

SEQ ID NO: 2793 - DNA, 72 bp, Artificial Sequence
  Chemically synthesized
tcgagcagaacatcgaaacttccgttcccagaacatcgaaacttccgttcccagaacatcgaaacttccggc

SEQ ID NO: 2794 - DNA, 26 bp, Artificial Sequence
  Chemically synthesized
ggccgctcctgagacacatgggtgac

SEQ ID NO: 2795 - DNA, 26 bp, Artificial Sequence
  Chemically synthesized
tcgagtcacccatgtgtctcaggagc

SEQ ID NO: 2796 - DNA, 26 bp, Artificial Sequence
  Chemically synthesized
ggccgctcacccatgtgtctcaggac

SEQ ID NO: 2797 - DNA, 26 bp, Artificial Sequence
  Chemically synthesized
tcgagtcctgagacacatgggtgagc

SEQ ID NO: 2798 - DNA, 26 bp, Artificial Sequence
  Chemically synthesized
ggccgcgcctgagaacacgtgtgtcc

SEQ ID NO: 2799 - DNA, 26 bp, Artificial Sequence
  Chemically synthesized
tcgaggacacacgtgttctcaggcgc

SEQ ID NO: 2800 - DNA, 26 bp, Artificial Sequence
  Chemically synthesized
ggccgcgcacccattgtgatacttcc

SEQ ID NO: 2801 - DNA, 26 bp, Artificial Sequence
  Chemically synthesized
tcgaggaagtatcacaatgggtgcgc

SEQ ID NO: 2802 - DNA, 72 bp, Artificial Sequence
  Chemically synthesized
ggccgcgcctgagaacacgtgtgtcggaagcctgagaacacgtgtgtcggaagcctgagaacacgtgtgtcc

SEQ ID NO: 2803 - DNA, 72 bp, Artificial Sequence
  Chemically synthesized
tcgaggacacacgtgttctcaggcttccgacacacgtgttctcaggcttccgacacacgtgttctcaggcgc

SEQ ID NO: 2804 - DNA, 72 bp, Artificial Sequence
  Chemically synthesized
ggccgcgcacccattgtgatacttcggaagcacccattgtgatacttcggaagcacccattgtgatacttcc

SEQ ID NO: 2805 - DNA, 72 bp, Artificial Sequence
  Chemically synthesized
tcgaggaagtatcacaatgggtgcttccgaagtatcacaatgggtgcttccgaagtatcacaatgggtgcgc

SEQ ID NO: 2806 - DNA, 26 bp, Artificial Sequence
  Chemically synthesized
ggccgcacaggcctctacaactacac

SEQ ID NO: 2807 - DNA, 26 bp, Artificial Sequence
  Chemically synthesized
tcgagtgtagttgtagaggcctgtgc

SEQ ID NO: 2808 - DNA, 26 bp, Artificial Sequence
  Chemically synthesized
ggccgctgtagttgtagaggcctgtc

SEQ ID NO: 2809 - DNA, 26 bp, Artificial Sequence
  Chemically synthesized
tcgagacaggcctctacaactacagc

SEQ ID NO: 2810 - DNA, 26 bp, Artificial Sequence
  Chemically synthesized
ggccgcacaggcctagcacaagcacc

SEQ ID NO: 2811 - DNA, 26 bp, Artificial Sequence
  Chemically synthesized
tcgaggtgcttgtgctaggcctgtgc

SEQ ID NO: 2812 - DNA, 26 bp, Artificial Sequence
  Chemically synthesized
ggccgcggtagttggctctgaagtgc

SEQ ID NO: 2813 - DNA, 26 bp, Artificial Sequence
  Chemically synthesized
tcgagcacttcagagccaactaccgc

SEQ ID NO: 2814 - DNA, 72 bp, Artificial Sequence
  Chemically synthesized
ggccgcacaggcctagcacaagcacggaaacaggcctagcacaagcacggaaacaggcctagcacaagcacc

SEQ ID NO: 2815 - DNA, 72 bp, Artificial Sequence
  Chemically synthesized
tcgaggtgcttgtgctaggcctgtttccgtgcttgtgctaggcctgtttccgtgcttgtgctaggcctgtgc

SEQ ID NO: 2816 - DNA, 72 bp, Artificial Sequence
  Chemically synthesized
ggccgcggtagttggctctgaagtgggaaggtagttggctctgaagtgggaaggtagttggctctgaagtgc

SEQ ID NO: 2817 - DNA, 72 bp, Artificial Sequence
  Chemically synthesized
tcgagcacttcagagccaactaccttcccacttcagagccaactaccttcccacttcagagccaactaccgc

SEQ ID NO: 2818 - DNA, 26 bp, Artificial Sequence
  Chemically synthesized
ggccgcgacaagatgcgagacgagac

SEQ ID NO: 2819 - DNA, 26 bp, Artificial Sequence
  Chemically synthesized
tcgagtctcgtctcgcatcttgtcgc

SEQ ID NO: 2820 - DNA, 26 bp, Artificial Sequence
  Chemically synthesized
ggccgctctcgtctcgcatcttgtcc

SEQ ID NO: 2821 - DNA, 26 bp, Artificial Sequence
  Chemically synthesized
tcgaggacaagatgcgagacgagagc

SEQ ID NO: 2822 - DNA, 26 bp, Artificial Sequence
  Chemically synthesized
ggccgctacaagattatctcatctcc

SEQ ID NO: 2823 - DNA, 26 bp, Artificial Sequence
  Chemically synthesized
tcgaggagatgagataatcttgtagc

SEQ ID NO: 2824 - DNA, 26 bp, Artificial Sequence
  Chemically synthesized
ggccgcgctcgtctatactaggtgac

SEQ ID NO: 2825 - DNA, 26 bp, Artificial Sequence
  Chemically synthesized
tcgagtcacctagtatagacgagcgc

SEQ ID NO: 2826 - DNA, 72 bp, Artificial Sequence
  Chemically synthesized
ggccgctacaagattatctcatctcggaatacaagattatctcatctcggaatacaagattatctcatctcc

SEQ ID NO: 2827 - DNA, 72 bp, Artificial Sequence
  Chemically synthesized
tcgaggagatgagataatcttgtattccgagatgagataatcttgtattccgagatgagataatcttgtagc

SEQ ID NO: 2828 - DNA, 72 bp, Artificial Sequence
  Chemically synthesized
ggccgcgctcgtctatactaggtgaggaagctcgtctatactaggtgaggaagctcgtctatactaggtgac

SEQ ID NO: 2829 - DNA, 72 bp, Artificial Sequence
  Chemically synthesized
tcgagtcacctagtatagacgagcttcctcacctagtatagacgagcttcctcacctagtatagacgagcgc

SEQ ID NO: 2830 - DNA, 26 bp, Artificial Sequence
  Chemically synthesized
ggccgcgacaagatgcgagacgagtc

SEQ ID NO: 2831 - DNA, 26 bp, Artificial Sequence
  Chemically synthesized
tcgagactcgtctcgcatcttgtcgc

SEQ ID NO: 2832 - DNA, 26 bp, Artificial Sequence
  Chemically synthesized
ggccgcactcgtctcgcatcttgtcc

SEQ ID NO: 2833 - DNA, 26 bp, Artificial Sequence
  Chemically synthesized
tcgaggacaagatgcgagacgagtgc

SEQ ID NO: 2834 - DNA, 26 bp, Artificial Sequence
  Chemically synthesized
ggccgcactccaagatcaacttccgc

SEQ ID NO: 2835 - DNA, 26 bp, Artificial Sequence
  Chemically synthesized
tcgagcggaagttgatcttggagtgc

SEQ ID NO: 2836 - DNA, 26 bp, Artificial Sequence
  Chemically synthesized
ggccgccggaagttgatcttggagtc

SEQ ID NO: 2837 - DNA, 26 bp, Artificial Sequence
  Chemically synthesized
tcgagactccaagatcaacttccggc

SEQ ID NO: 2838 - DNA, 26 bp, Artificial Sequence
  Chemically synthesized
ggccgctcctgagacacatgggtgcc

SEQ ID NO: 2839 - DNA, 26 bp, Artificial Sequence
  Chemically synthesized
tcgaggcacccatgtgtctcaggagc

SEQ ID NO: 2840 - DNA, 26 bp, Artificial Sequence
  Chemically synthesized
ggccgcgcacccatgtgtctcaggac

SEQ ID NO: 2841 - DNA, 26 bp, Artificial Sequence
  Chemically synthesized
tcgagtcctgagacacatgggtgcgc

SEQ ID NO: 2842 - DNA, 26 bp, Artificial Sequence
  Chemically synthesized
ggccgcacaggcctctacaactactc

SEQ ID NO: 2843 - DNA, 26 bp, Artificial Sequence
  Chemically synthesized
tcgagagtagttgtagaggcctgtgc

SEQ ID NO: 2844 - DNA, 26 bp, Artificial Sequence
  Chemically synthesized
ggccgcagtagttgtagaggcctgtc

SEQ ID NO: 2845 - DNA, 26 bp, Artificial Sequence
  Chemically synthesized
tcgagacaggcctctacaactactgc

That which is claimed is:

1. A double stranded nucleic acid molecule having a structure (A2) set forth below:

$$5' \quad N^1 - (N)x - Z \quad 3' \text{ (antisense strand)}$$
$$3' \quad Z' - N^2 - (N')y_{-z''} \quad 5' \text{ (sense strand)}$$
(A2)

wherein each of $N^2$, N and N' is independently an unmodified or modified ribonucleotide, or an unconventional moiety;

wherein each of (N)x and (N')y is an oligonucleotide in which each consecutive N or N' is joined to the adjacent N or N' by a covalent bond;

wherein each of x and y is 18;

wherein the sequence of (N')y has complementarity to the sequence of (N)x and the sequence of (N)x has complementarity to a consecutive sequence in a mRNA encoding hsp47;

wherein $N^1$ is covalently bound to (N)x and is mismatched to the mRNA encoding hsp47;

or is a complementary DNA moiety to the mRNA encoding hsp47;

wherein $N^1$ is a moiety selected from natural or modified uridine or deoxyribouridine;

wherein z" may be present or absent, but if present is a capping moiety covalently attached at the 5' terminus of $N^2$—(N')y;

wherein each of Z and Z' is independently present or absent, but if present is independently 1-5 consecutive nucleotides, consecutive non-nucleotide moieties or a combination thereof covalently attached at the 3' terminus of the strand in which it is present; and wherein the sense strand and the antisense strand comprise the oligonucleotides described as SERPINH1_2 (SEQ ID NOS: 60 and 127).

2. A composition comprising the double stranded nucleic acid molecule of claim 1; and a pharmaceutically acceptable carrier.

3. The double stranded nucleic acid molecule of claim 1, having the structure

```
5' UAUAGCACCCAUGUGUCUC-Z 3'    (antisense
   |||||||||||||||||||          SEQ ID NO: 127)
3' Z'-AUAUCGUGGGUACACAGAG-z" 5' (sense
                                 SEQ ID NO: 60)
``` wherein each "|" represents base pairing between the ribonucleotides;

wherein each of A, C, G and U is independently an unmodified or modified ribonucleotide, or an unconventional moiety;

wherein each A, C, G and U is joined to an adjacent A, C, G or U by a covalent bond;

wherein each of Z and Z' is independently present or absent, but if present is independently 1-5 consecutive nucleotides or non-nucleotide moieties or a combination thereof covalently attached at the 3' terminus of the strand in which it is present; and wherein z" may be present or absent, but if present is a capping moiety covalently attached at the 5' terminus of the sense strand.

4. The double stranded nucleic acid molecule of claim 3, wherein each of A, C, G and U is an unmodified ribonucleotide, and wherein z", Z and Z' are absent.

5. The double stranded nucleic acid molecule of claim 3, wherein each of Z and Z' is present.

6. The double stranded nucleic acid molecule of claim 5, wherein each of Z and Z' independently comprises a nucleotide overhang or a non-nucleotide overhang.

7. The double stranded nucleic acid molecule of claim 6, wherein each of Z and Z' comprises a non-nucleotide overhang.

8. The double stranded nucleic acid molecule of claim 7, wherein Z' comprises C3Pi and wherein Z comprises C3Pi-C3OH.

9. The double stranded nucleic acid molecule of claim 3, wherein the antisense strand comprises 2'-O-methyl sugar modified ribonucleotides.

10. The double stranded nucleic acid molecule of claim 9, wherein the 2'-O-methyl sugar modified ribonucleotides are present in positions (5'>3') 3, 5, 9, 11, 13, 15, 17 and 19.

11. The double stranded nucleic acid molecule of claim 10, wherein the antisense strand further comprises a 2'-O-methyl sugar modified ribonucleotide or a 2'5' ribonucleotide in position (5'>3') 1.

12. The double stranded nucleic acid molecule of claim 11, wherein the antisense strand comprises a 2'-O-methyl sugar modified ribonucleotide in position (5'>3') 1.

13. The double stranded nucleic acid molecule of claim 11, wherein the antisense strand comprises a 2'5' ribonucleotide in position (5'>3') 1.

14. The double stranded nucleic acid molecule of claim 11, wherein the antisense strand comprises a 2'5' ribonucleotide in any one of positions (5'>3') 6, 7 or 8.

15. The double stranded nucleic acid molecule of claim 14, wherein the 2'5' ribonucleotide is present in position 7.

16. The double stranded nucleic acid molecule of claim 3, wherein the sense strand comprises 4 or 5 consecutive 2'5' nucleotides at the 3' terminal or penultimate positions.

17. The double stranded nucleic acid molecule of claim 16, wherein the sense strand comprises 2'5' ribonucleotides in positions (5'>3') 15, 16, 17, and 18.

18. The double stranded nucleic acid molecule of claim 16, wherein the sense strand comprises 2'5' ribonucleotides in positions (5'>3') 15, 16, 17, 18 and 19.

19. The double stranded nucleic acid molecule of claim 3, wherein the sense strand comprises 2'-O-methyl sugar modified ribonucleotides in positions (5'>3') 7, 13, 16 and 18.

20. The double stranded nucleic acid molecule of claim 19, wherein the sense strand further comprises a 2'5' nucleotide in position (5'>3') 9.

21. The double stranded nucleic acid molecule of claim 3, wherein z" is present and comprises a capping moiety covalently attached to the 5' terminus of the sense strand.

22. The double stranded nucleic acid molecule of claim 21, wherein the capping moiety is selected from an abasic ribose moiety, an inverted abasic ribose moiety, an inverted abasic deoxyribose moiety, an abasic deoxyribose moiety and modifications thereof; C6-imino-Pi; a mirror nucleotide; 5'OMe nucleotide; 4',5'-methylene nucleotide; 1-(β-D-erythrofuranosyl)nucleotide; 4'-thio nucleotide, carbocyclic nucleotide; 5'-amino-alkyl phosphate; 1,3-diamino-2-propyl phosphate, 3-aminopropyl phosphate; 6-aminohexyl phosphate; 12-aminododecyl phosphate; hydroxypropyl phosphate; 1,5-anhydrohexitol nucleotide; alpha-nucleotide; threo-pentofuranosyl nucleotide; acyclic 3',4'-seco nucleotide; 3,4-dihydroxybutyl nucleotide; 3,5-dihydroxypentyl nucleotide, 5'-5'-inverted abasic moiety; 1,4-butanediol phosphate; 5'-amino; and bridging or non bridging methylphosphonate and 5'-mercapto moieties.

23. The double stranded nucleic acid molecule of claim 22, wherein the capping moiety comprises an inverted abasic deoxyribose moiety.

24. The double stranded nucleic acid molecule of claim 1, wherein the antisense strand comprises 2'-O-methyl sugar modified ribonucleotides, a 2'5' ribonucleotide in at least one of positions (5'>3') 1, 5, 6 or 7, and a 3' terminal non-nucleotide moiety covalently attached to the 3' terminus; and wherein the sense strand comprises at least one 2'5' ribonucleotide and/or a 2'-O-methyl modified ribonucleotide, a non-nucleotide moiety covalently attached at the 3' terminus and a capping moiety covalently attached at the 5' terminus.

25. The double stranded nucleic acid molecule of claim 24, wherein the antisense strand comprises 2'-O-methyl sugar modified ribonucleotides at positions (5'>3') 3, 5, 9, 11, 13, 15, 17 and 19, a 2'5' ribonucleotide in position 7, and a non-nucleotide moiety covalently attached at the 3' terminus; and wherein the sense strand comprises five consecutive 2'5' ribonucleotides in the 3' terminal positions (5'>3') 15, 16, 17, 18 and 19, a non-nucleotide moiety covalently attached at the 3' terminus and an inverted abasic capping moiety covalently attached at the 5' terminus.

26. The double stranded nucleic acid molecule of claim 25, wherein the antisense strand comprises 2'-O-methyl sugar modified ribonucleotides at positions (5'>3') 1, 3, 5, 9, 11, 13, 15, 17 and 19, a 2'5' ribonucleotide in position 7, and a C3Pi-C3OH non-nucleotide moiety covalently attached at the 3' terminus; and wherein the sense strand comprises five consecutive 2'5' ribonucleotides in the 3' terminal positions (5'>3') 15, 16, 17, 18 and 19, a C3Pi non-nucleotide moiety covalently attached at the 3' terminus and an inverted abasic capping moiety covalently attached at the 5' terminus.

27. The double stranded nucleic acid molecule of claim 25, wherein the antisense strand comprises 2'-O-methyl sugar modified ribonucleotides at positions (5'>3') 3, 5, 9, 11, 13, 15, 17 and 19, a 2'5' ribonucleotide in positions 1 and 7, and a C3Pi-C3OH non-nucleotide moiety covalently attached at the 3' terminus; and wherein the sense strand comprises five consecutive 2'5' ribonucleotides in the 3' terminal positions (5'>3') 15, 16, 17, 18 and 19, a C3Pi non-nucleotide moiety covalently attached at the 3' terminus and an inverted abasic capping moiety covalently attached at the 5' terminus.

28. The double stranded nucleic acid molecule of claim 24, wherein the antisense strand comprises 2'-O-methyl sugar modified ribonucleotides in positions (5'>3') 1, 3, 5, 9, 11, 13, 15, 17 and 19, a 2'5' ribonucleotide in position 7, and a C3Pi-C3OH non-nucleotide moiety covalently attached at the 3' terminus; and wherein the sense strand comprises 2'-O-methyl sugar modified ribonucleotides in positions (5'>3') 7, 13, 16 and 18, a 2'5' ribonucleotide at position 9, a C3 non-nucleotide moiety covalently attached at the 3' terminus and an inverted abasic capping moiety covalently attached at the 5' terminus.

29. A method for treating an individual suffering from a disease associated with hsp47 comprising administering to said individual the double stranded nucleic acid molecule of claim 1 in an amount sufficient to reduce expression of hsp47, wherein the disease associated with hsp47 is fibrosis.

30. A method for treating an individual suffering from a disease associated with hsp47 comprising administering to said individual the double stranded nucleic acid molecule of claim 26 in an amount sufficient to reduce expression of hsp47, wherein the disease associated with hsp47 is fibrosis.

31. The method of claim 30 wherein the fibrosis is selected from the group consisting of liver fibrosis, liver cirrhosis, pulmonary fibrosis, kidney fibrosis, peritoneal fibrosis, chronic hepatic damage, cardiofibrosis, retinal fibrosis, retro-orbital fibrosis, lacrimal gland fibrosis, myelofibrosis, intestinal fibrosis, vocal cord mucosal fibrosis, laryngeal fibrosis, nephrogenic systemic fibrosis, congenital hepatic fibrosis and oral submucosal fibrosis.

32. The method of claim 31, wherein the fibrosis comprises liver cirrhosis, liver fibrosis, pulmonary fibrosis, kidney fibrosis, myelofibrosis and intestinal fibrosis.

33. The double stranded nucleic acid molecule of claim 3, wherein each covalent bond joining each A, C, G and U to the adjacent A, C, G or U is a phosphodiester bond.

34. The method of claim 30 wherein the fibrosis is a fibrosis of skin, peritoneum, liver, pancreas, kidney, heart, lung, bone marrow, eye, intestine, vocal cord and/or vasculature.

35. The method of claim 29, wherein the fibrosis is selected from the group consisting of liver fibrosis, liver cirrhosis, pulmonary fibrosis, kidney fibrosis, peritoneal fibrosis, chronic hepatic damage, cardiofibrosis, retinal fibrosis, retro-orbital fibrosis, lacrimal gland fibrosis, myelofibrosis, intestinal fibrosis, vocal cord mucosal fibrosis, laryngeal fibrosis, nephrogenic systemic fibrosis, congenital hepatic fibrosis and oral submucosal fibrosis.

36. The method of claim 35, wherein the fibrosis comprises liver fibrosis, liver cirrhosis, pulmonary fibrosis, kidney fibrosis, myelofibrosis and intestinal fibrosis.

37. The method of claim 29 wherein the fibrosis is a fibrosis of skin, peritoneum, liver, pancreas, kidney, heart, lung, bone marrow, eye, intestine, vocal cord and/or vasculature.

\* \* \* \* \*

UNITED STATES PATENT AND TRADEMARK OFFICE
CERTIFICATE OF CORRECTION

PATENT NO. : 8,710,209 B2  
APPLICATION NO. : 12/963600  
DATED : April 29, 2014  
INVENTOR(S) : Xiaomei Jin et al.

Page 1 of 1

It is certified that error appears in the above-identified patent and that said Letters Patent is hereby corrected as shown below:

In the claims:

Column 218, line 27: In Claim 3, delete "antisense SEQ ID NO: 127" and insert --antisense strand SEQ ID NO: 127--

Column 218, line 29: In Claim 3, delete "sense SEQ ID NO: 60" and insert --sense strand SEQ ID NO: 60--

Signed and Sealed this  
Twenty-fourth Day of May, 2016

Michelle K. Lee  
*Director of the United States Patent and Trademark Office*